US011377658B2

(12) United States Patent
Gottesman et al.

(10) Patent No.: US 11,377,658 B2
(45) Date of Patent: Jul. 5, 2022

(54) OLIGONUCLEOTIDES FOR TREATMENT OF ANGIOPOIETIN LIKE 4 (ANGPTL4) RELATED DISEASES

(71) Applicant: EMPIRICO INC., San Diego, CA (US)

(72) Inventors: Omri Gottesman, San Diego, CA (US); Shannon Bruse, San Diego, CA (US); Brian Cajes, San Diego, CA (US); David Lewis, Madison, WI (US); David Rozema, Cross Plains, WI (US)

(73) Assignee: EMPIRICO INC., San Diego, CA (US)

(*) Notice: Subject to any disclaimer, the term of this patent is extended or adjusted under 35 U.S.C. 154(b) by 0 days.

(21) Appl. No.: 17/476,317

(22) Filed: Sep. 15, 2021

(65) Prior Publication Data

US 2022/0002731 A1     Jan. 6, 2022

Related U.S. Application Data

(63) Continuation of application No. PCT/US2020/063824, filed on Dec. 8, 2020.

(60) Provisional application No. 62/945,732, filed on Dec. 9, 2019.

(51) Int. Cl.
C12N 15/113      (2010.01)

(52) U.S. Cl.
CPC ...... *C12N 15/1136* (2013.01); *C12N 2310/14* (2013.01); *C12N 2310/315* (2013.01); *C12N 2310/321* (2013.01); *C12N 2310/322* (2013.01); *C12N 2310/351* (2013.01)

(58) Field of Classification Search
None
See application file for complete search history.

(56) References Cited

U.S. PATENT DOCUMENTS

| 7,691,997 B2* | 4/2010 | Khvorova ......... G16B 20/50 536/24.5 |
| 9,352,048 B2 | 5/2016 | Manoharan et al. |
| 2007/0054856 A1 | 3/2007 | Gerber et al. |
| 2010/0172915 A1 | 7/2010 | Gerber et al. |
| 2012/0035115 A1 | 2/2012 | Manoharan et al. |
| 2012/0207770 A1 | 8/2012 | Tan et al. |
| 2019/0038768 A1 | 2/2019 | Rajeev et al. |
| 2019/0202855 A1 | 7/2019 | Sakamuri et al. |

FOREIGN PATENT DOCUMENTS

| WO | WO-2015069932 A1 | 5/2015 |
| WO | WO-2015188197 A2 | 12/2015 |
| WO | WO-2018002719 A1 | 1/2018 |
| WO | WO-2019053661 A2 | 3/2019 |
| WO | WO-2019217527 A1 | 11/2019 |
| WO | WO-2021119019 A1 | 6/2021 |

OTHER PUBLICATIONS

ANGPTL4 siRNAs available for purchase from Thermo Fisher and other vendors. Santa Cruz Technology Inc. (2020).
Aryal et al., ANGPTL4 in metabolic and cardiovascular disease. Trends in Molecular Medicine 25(8):723-734 (2019).
Hsieh et al.: Epigenetic silencing of the dual-role signal mediator, ANGPTL4 in tumortissues and its overexpression in the urothelial carcinoma microenvironment. Oncogene 37(5):673-686 (2018) Epub 2017.
PCT/US2020/063824 International Invitation to Pay Additional Fees dated Mar. 15, 2021.
PCT/US2020/063824 International Search Report and Written Opinion dated May 6, 2021.

* cited by examiner

*Primary Examiner* — Tracy Vivlemore
(74) *Attorney, Agent, or Firm* — Wilson Sonsini Goodrich & Rosati

(57) ABSTRACT

Provided are compositions comprising an oligonucleotide that targets Angiopoietin-like 4 (ANGPTL4). The oligonucleotide may include a small interfering RNA (siRNA) or an antisense oligonucleotide (ASO). Also provided herein are methods of treating a metabolic or cardiovascular disorder by providing an oligonucleotide that targets ANGPTL4 to a subject in need thereof.

20 Claims, No Drawings

Specification includes a Sequence Listing.

OLIGONUCLEOTIDES FOR TREATMENT OF ANGIOPOIETIN LIKE 4 (ANGPTL4) RELATED DISEASES

CROSS-REFERENCE

The present application is a continuation of International Patent Application No. PCT/US2020/063824, filed Dec. 8, 2020, which claims the benefit of U.S. Provisional Application No. 62/945,732 filed Dec. 9, 2019, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Sep. 15, 2021, is named 54462-712_301_SL.txt and is 4,087,518 bytes in size.

BACKGROUND

Cardiovascular and metabolic disorders are becoming increasingly abundant, and may affect a wide variety of persons. Improved therapeutics are needed for treating these disorders.

SUMMARY

Disclosed herein, in some embodiments, are compositions comprising an oligonucleotide that targets Angiopoietin-like 4 (ANGPTL4) and when administered to a subject in an effective amount decreases circulating triglycerides, decreases circulating glucose, increases circulating high-density lipoproteins (HDL), or increases insulin sensitivity, wherein the oligonucleotide comprises a small interfering RNA (siRNA) comprising a sense strand and an antisense strand, the antisense strand being complementary with no more than 2 mismatches to a portion of a nucleic acid having the nucleoside sequence of SEQ ID NO: 13935, and each strand having 12 to 30 nucleotides. In some embodiments, the triglycerides, total cholesterol, or glucose is decreased by about 10% or more, or the HDL or insulin sensitivity is increased by about 10% or more, as compared to prior to administration. In some embodiments, the antisense strand is complementary with no more than 2 mismatches to a portion of a nucleic acid having the nucleoside sequence of SEQ ID NO: 13936. In some embodiments, the antisense strand comprises a nucleoside sequence at least 85% identical to an antisense strand sequence of an siRNA in Table 4. In some embodiments, the antisense strand comprises the nucleoside sequence of an antisense strand sequence of an siRNA in Table 4, or an antisense strand sequence thereof having 1 or 2 nucleoside substitutions, additions, or deletions. In some embodiments, the antisense strand comprises the nucleoside sequence of an antisense strand sequence of an siRNA in Table 4. In some embodiments, the sense strand comprises a nucleoside sequence at least 85% identical to the sense strand sequence of the siRNA in Table 4. In some embodiments, the sense strand comprises the nucleoside sequence of the sense strand sequence of the siRNA in Table 4, or a sense strand sequence thereof having 1 or 2 nucleoside substitutions, additions, or deletions. In some embodiments, the sense strand comprises the nucleoside sequence of the sense strand sequence of the siRNA in Table 4. In some embodiments, the antisense strand comprises a nucleoside sequence at least 85% identical to SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696. In some embodiments, the antisense strand comprises the nucleoside sequence of SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or an antisense strand sequence thereof having 1 or 2 nucleoside substitutions, additions, or deletions. In some embodiments, the antisense strand comprises the nucleoside sequence of SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696. In some embodiments, the sense strand comprises a nucleoside sequence at least 85% identical to SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842. In some embodiments, the sense strand comprises the nucleoside sequence of SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, or a sense strand sequence thereof having 1 or 2 nucleoside substitutions, additions, or deletions. In some embodiments, the sense strand comprises the nucleoside sequence of SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842. In some embodiments, the antisense strand comprises a nucleoside sequence at least 85% identical to any of SEQ ID NOS: 13978-13981. In some embodiments, the antisense strand comprises the nucleoside sequence of any of SEQ ID NOS: 13978-13981, or an antisense strand sequence thereof having 1 or 2 nucleoside substitutions, additions, or deletions. In some embodiments, the antisense strand comprises the nucleoside sequence of any of SEQ ID NOS: 13978-13981. In some embodiments, the sense strand comprises a nucleoside sequence at least 85% identical to any of SEQ ID NOS: 13970-13973. In some embodiments, the sense strand comprises the nucleoside sequence of any of SEQ ID NOS: 13970-13973, or a sense strand sequence thereof having 1 or 2 nucleoside substitutions, additions, or deletions. In some embodiments, the sense strand comprises the nucleoside sequence of any of SEQ ID NOS: 13970-13973. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises a phosphorothioate linkage. In some embodiments, the sense strand comprises 2-6 modified internucleoside linkages. In some embodiments, the antisense strand comprises 2-6 modified internucleoside linkages. In some embodiments, the oligonucleotide comprises a modified nucleoside. In some embodiments, the modified nucleoside comprise a locked nucleic acid (LNA), hexitol nucleic acid (HLA), cyclohexene nucleic acid (CeNA), a 2',4' constrained ethyl, 2'-methoxyethyl, 2'-O-alkyl, 2'-O-allyl, 2'-O-allyl, 2'-fluoro, 2'-deoxy, a 2' 0 methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, 2' ara-F, or a combination thereof. In some embodiments, the modified nucleoside comprises a 2' fluoro modified nucleoside. In some embodiments, the modified nucleoside comprises a 2' 0 methyl modified nucleoside. In some embodiments, the sense strand or antisense strand comprises 15-21 modified nucleosides. In some embodiments, the sense strand or the antisense strand comprises a 3' overhang of at least 2 nucleosides. In some embodiments, the oligonucleotide comprises a GalNAc ligand attached at a 3' or 5' terminus of the sense strand. In some embodiments, the oligonucleotide comprises a GalNAc ligand attached at a 3' or 5' terminus of the antisense strand In some embodiments, the sense strand comprises modification pattern 1S: 5' NfsnsNfnNfnNfNfNfnNfnNfnNfnNfnNfnNfsnsn-3' (SEQ ID NO: 13954), modification pattern 2S: 5' nsnsnnNfnNfNfN fnnnnnnnnnnnsnsn-3' (SEQ ID NO: 13955), modification pattern 3S: 5' nsnsnnNfnNfnNfnnnnnnnnnnnsnsn-3' (SEQ ID NO: 13956), modification pattern 4S: 5' NfsnsNfnNfnNfN fNfnNfnNfnNfnNfnNfsnsnN-3' (SEQ ID NO: 13957), modification pattern 5S: 5'-nsnsnnNfnNfNfN fnnnnnnnnnnnsnsnN-3' (SEQ ID NO: 13958); modification pattern 6S: 5' NfsnsNfnNfnNfnNfnNfnNfnNfnNfnNfsnsn 3' (SEQ ID NO: 13959); wherein "Nf" is a 2' fluoro-modified nucleoside, "n" is a 2' O-methyl modified nucleoside, "s" is a phosphorothioate linkage, and N comprises a nucleoside. In some embodiments, the antisense strand comprises modification pattern 1AS: 5' nsNfsnNfnNfnNfn NfnnnNfnNfnNfnsnsn-3' (SEQ ID NO: 13960), modification pattern 2AS: 5' nsNfsnnnNfnNfNfnnnnNfnNfnnnsnsn-3' (SEQ ID NO: 13961), modification pattern 3AS: 5' nsNfsnnnNfnnnnnnnNfnNfnnnsnsn-3' (SEQ ID NO: 13962), modification pattern 4AS: 5' nsNfsnNfnNf nnnnnnnNfnNfnnnsnsn 3' (SEQ ID NO: 13963), modification pattern 5AS: 5' nsNfsnnnNfnNfnnnnnNfnNfnnnsnsn 3' (SEQ ID NO: 13964), modification pattern 6AS: 5' nsNfsnNfnNfnNfnNfnNfnNfnNfnNfnsnsn 3' (SEQ ID NO: 13965), modification pattern 7AS: 5' nsNfsnNfnNfnNf NfnnnnNfnNfnnnsnsn 3' (SEQ ID NO: 13966), modification pattern 8AS: 5' nsNfsnnnnnnnnnnnNfnNfnnnsnsn 3' (SEQ ID NO: 13967), or modification pattern 9AS: 5' nsNfsnnnNfnnnnnnnnNfnNfnNfnsnsn 3' (SEQ ID NO: 13968); wherein "Nf" is a 2' fluoro-modified nucleoside, "n" is a 2' O-methyl modified nucleoside, and "s" is a phosphorothioate linkage. In some embodiments, the composition is a pharmaceutical composition comprising a pharmaceutically acceptable carrier. In some embodiments, the pharmaceutically acceptable carrier comprises water, a buffer, or a saline solution.

Disclosed herein, are methods of treating a metabolic or cardiovascular disorder in a subject in need thereof, the method comprising administering to the subject an effective amount of a composition comprising an oligonucleotide that targets ANGPTL4, wherein the oligonucleotide comprises a small interfering RNA (siRNA) comprising a sense strand and an antisense strand, the antisense strand being complementary with no more than 2 mismatches to a portion of a nucleic acid having the nucleoside sequence of SEQ ID NO: 13936, and each strand having 12 to 30 nucleotides. In some embodiments, the disorder comprises hyperlipidemia, hypertriglyceridemia, pancreatitis, familial chylomicronemia syndrome, diabetes, type 2 diabetes, heart disease, a myocardial infarction, angina pectoris, or atherosclerosis. In some embodiments, the effective amount of the composition decreases a triglyceride measurement, decreases a cholesterol measurement, decreases a glucose measurement, increases an HDL measurement, or increases an insulin sensitivity measurement in the subject by about 10% or more, relative to a baseline measurement. In some embodiments, the antisense strand is complementary with no more than 2 mismatches to a portion of a nucleic acid having the nucleoside sequence of SEQ ID NO: 13935. In some embodiments, the antisense strand comprises a nucleoside sequence at least 85% identical to SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696. In some embodiments, the antisense strand comprises the nucleoside sequence of SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or an antisense strand sequence thereof having 1 or 2 nucleoside substitutions, additions, or deletions. In some embodiments, the antisense strand comprises the nucleoside sequence of SEQ ID NO: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696. In some embodiments, the sense strand comprises a nucleoside sequence at least 85% identical to SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842. In some embodiments, the sense strand comprises the nucleoside sequence of SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, or a sense strand sequence thereof having 1 or 2 nucleoside substitutions, additions, or deletions. In some embodiments, the sense strand comprises the nucleoside sequence of SEQ ID NO: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842. In some embodiments, the antisense strand comprises a nucleoside sequence at least 85% identical to any of SEQ ID NOS: 13978-13981. In some embodiments, the antisense strand comprises the nucleoside sequence of any of SEQ ID NOS: 13978-13981, or an antisense strand sequence thereof having 1 or 2 nucleoside substitutions, additions, or deletions. In some embodiments, the antisense strand comprises the nucleoside sequence of any of SEQ ID NOS: 13978-13981. In some embodiments, the sense strand comprises a nucleoside sequence at least 85% identical to any of SEQ ID NOS: 13970-13973. In some embodiments, the sense strand comprises the nucleoside sequence of any of SEQ ID NOS: 13970-13973, or a sense strand sequence thereof having 1 or 2 nucleoside substitutions, additions, or deletions. In some embodiments, the sense strand comprises the nucleoside sequence of any of SEQ ID NOS: 13970-13973. In some embodiments, the oligonucleotide comprises a modified internucleoside linkage comprising: alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the oligonucleotide comprises a modified nucleoside comprising: a locked nucleic acid (LNA), hexitol nucleic acid (HLA), cyclohexene nucleic acid (CeNA), a 2',4' constrained ethyl, 2'-methoxyethyl, 2'-O-alkyl, 2'-O-allyl, 2'-O-allyl, 2'-fluoro, 2'-deoxy, a 2' 0 methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, 2' ara-F, or a combination thereof. In some embodiments, the sense strand or the antisense strand comprises a 3' overhang of at least 2 nucleosides. In some embodiments, the oligonucleotide comprises a GalNAc ligand attached at a 3' or 5' terminus of the sense strand. In some embodiments, the oligonucleotide comprises a GalNAc ligand attached at a 3' or 5' terminus of the antisense strand In some embodiments, the sense strand comprises modification pattern 1S: 5' NfsnsNfnNfnNfnNfnNfnNfnNfnNfnNfnNfsnsn-3' (SEQ ID NO: 13954), modification pattern 2S: 5' nsnsnnNfnNfNfNfnnnnnnnnnnsnsn-3' (SEQ ID NO: 13955), modification pattern 3S: 5' nsnsnnNfn NfnNfnnnnnnnnnsnsn-3' (SEQ ID NO: 13956), modification pattern 4S: 5' NfsnsNfnNfnNfNfNfnNfnNfn NfnNfnNfsnsnN-3' (SEQ ID NO: 13957), modification pattern 5S: 5'-nsnsnnNfnNfNfNfnnnnnnnnnsnsnN-3' (SEQ ID NO: 13958); modification pattern 6S: 5' NfsnsNfn NfnNfnNfnNfnNfnNfnNfnNfsnsn 3' (SEQ ID NO: 13959); wherein "Nf" is a 2' fluoro-modified nucleoside, "n" is a 2' O-methyl modified nucleoside, "s" is a phosphorothioate linkage, and N comprises a nucleoside. In some embodiments, the antisense strand comprises modification pattern 1AS: 5' nsNfsnNfnNfnNfnNfnNfnnnNfnNfnNfsnsn-3' (SEQ ID NO: 13960), modification pattern 2AS: 5' nsNfsnnnN fnNfNfnnnnNfnNfnnnsnsn-3' (SEQ ID NO: 13961), modification pattern 3AS: 5' nsNfsnnnNfnnnnnnnNfnNfnnnsnsn-3' (SEQ ID NO: 13962), modification pattern 4AS: 5' nsNfsnNfnNfnnnnnnnnNfnNfnnnsnsn 3' (SEQ ID NO: 13963), modification pattern 5AS: 5' nsNfsnnnNfn NfnnnnnNfnNfnnnsnsn 3' (SEQ ID NO: 13964), modification pattern 6AS: 5' nsNfsnNfnNfnNfnN fnNfnNfnNfnNfsnsn 3' (SEQ ID NO: 13965), modification pattern 7AS: 5' nsNfsnNfnNfnNfNfnnnnNfnNfnnnsnsn 3' (SEQ ID NO: 13966), modification pattern 8AS: 5' nsNfsnnnnnnnnnnnNfnnnnnsnsn 3' (SEQ ID NO: 13967), or modification pattern 9AS: 5' nsNfsnnnNfnnn nnnnNfnNfnNfsnsn 3' (SEQ ID NO: 13968); wherein "Nf" is a 2' fluoro-modified nucleoside, "n" is a 2' O-methyl modified nucleoside, and "s" is a phosphorothioate linkage.

Disclosed herein are compositions comprising an oligonucleotide that targets Angiopoietin-like 4 (ANGPTL4) and when administered to a subject in an effective amount decreases circulating triglycerides. In some embodiments, the triglycerides are decreased by about 10% or more, as compared to prior to administration. Also disclosed herein are compositions comprising an oligonucleotide that targets ANGPTL4 and when administered to a subject in an effective amount decreases circulating total cholesterol. In some embodiments, the total cholesterol is decreased by about 10% or more, as compared to prior to administration. Also disclosed herein are compositions comprising an oligonucleotide that targets ANGPTL4 and when administered to a subject in an effective amount increases circulating high-density lipoproteins (HDL). In some embodiments, the HDL are increased by about 10% or more, as compared to prior to administration. Also disclosed herein are compositions comprising an oligonucleotide that targets ANGPTL4 and when administered to a subject in an effective amount decreases circulating glucose. In some embodiments, the glucose is decreased by about 10% or more, as compared to prior to administration. Also disclosed herein are compositions comprising an oligonucleotide that targets ANGPTL4 and when administered to a subject in an effective amount increases insulin sensitivity. In some embodiments, the insulin sensitivity is increased by about 10% or more, as compared to prior to administration. In some embodiments, the oligonucleotide comprises a small interfering RNA (siRNA) comprising a sense strand and an antisense strand. In some embodiments, the sense strand is 14-30 nucleosides in length. In some embodiments, the antisense strand is 14-30 nucleosides in length. Also disclosed herein are compositions comprising an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13935. Also disclosed herein are compositions comprising an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13936. In some embodiments, the sense strand and the antisense strand form a double-stranded RNA duplex. In some embodiments, the first base pair of the double-stranded RNA duplex is an AU base pair. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 1-1854 or 13970-13977. In some embodiments, the sense strand further comprises a 3' overhang comprising 1, 2, or more nucleosides. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions. In some embodiments, the antisense strand comprises a nucleoside sequence comprising or consisting of the sequence of any one of SEQ ID NOs: 1855-3708 or 13978-13985. In some embodiments, the antisense strand further comprises a 3' overhang comprising 1, 2, or more nucleosides. In some embodiments, the siRNA binds with a 19mer in a human ANGPTL4 mRNA. In some embodiments, the siRNA binds with a 17mer in a non-human primate ANGPTL4 mRNA. In some embodiments, the siRNA binds with a 19mer in a human ANGPTL4 mRNA. In some embodiments, the siRNA binds with a human ANGPTL4 mRNA and less than or equal to 20 human off-targets, with no more than 2 mismatches in the antisense strand. In some embodiments, siRNA binds with a human ANGPTL4 mRNA target site that does not harbor an SNP, with a minor allele frequency (MAF) greater or equal to 1% (pos. 2-18). In some embodiments, the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside substitutions, additions, or deletions. In some embodiments, the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside substitutions, additions, or deletions. In some embodiments, the sense strand comprises the nucleoside sequence of any one of SEQ ID NO: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803. In some embodiments, the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657. In some embodiments, the sense strand comprises the nucleoside sequence of any one of SEQ ID NOs: 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, or 1787, or a nucleic acid sequence thereof having 1 or 2 nucleoside substitutions, additions, or deletions. In some embodiments, the antisense strand comprises the nucleoside sequence of any one of SEQ ID NOs: 1887, 1888, 1889, 1890, 1910, 1975, 2126, 2134, 2136, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2335, 2338, 2363, 2371, 2373, 2374, 2419, 2474, 2489, 2491, 2494, 2684, 2688, 2695, 2696, 2697, 2698, 2704, 2725, 2726, 2730, 2741, 2742, 2748, 2751, 2756, 2799, 2855, 2856, 2859, 2891, 2987, 2988, 2991, 3003, 3005, 3007, 3008, 3009, 3011, 3012, 3015, 3016, 3018, 3019, 3020, 3025, 3026, 3102, 3103, 3169, 3192, 3197, 3201, 3202, 3283, 3284, 3424, 3425, 3426, 3464, 3465, 3471, 3634, 3638, or 3641, or a nucleic acid sequence thereof having 1 or 2 nucleoside substitutions, additions, or deletions. In some embodiments, the sense strand comprises the nucleoside sequence of any one of SEQ ID NOs: 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, or 1803, or a nucleic acid sequence thereof having 1 or 2 nucleoside substitutions, additions, or deletions. In some embodiments, the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1966, 1970, 1971, 1972, 1973, 1974, 1979, 1980, 1981, 1982, 1983, 2003, 2004, 2006, 2007, 2011, 2012, 2013, 2015, 2018, 2019, 2020, 2021, 2022, 2023, 2026, 2028, 2029, 2050, 2053, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2234, 2236, 2240, 2242, 2245, 2246, 2247, 2248, 2251, 2252, 2253, 2256, 2258, 2259, 2265, 2266, 2267, 2268, 2269, 2274, 2275, 2276, 2277, 2278, 2279, 2280, 2281, 2282, 2283, 2284, 2285, 2289, 2338, 2371, 2373, 2374, 2419, 2424, 2425, 2426, 2461, 2462, 2464, 2465, 2466, 2470, 2471, 2474, 2489, 2491, 2494, 2526, 2527, 2528, 2529, 2530, 2531, 2532, 2533, 2535, 2536, 2537, 2538, 2540, 2541, 2543, 2546, 2549, 2684, 2695, 2696, 2697, 2698, 2704, 2705, 2706, 2707, 2708, 2710, 2711, 2720, 2722, 2725, 2726, 2730, 2741, 2742, 2744, 2746, 2747, 2748, 2756, 2765, 2766, 2767, 2768, 2769, 2770, 2771, 2772, 2773, 2774, 2775, 2776, 2799, 2855, 2856, 2859, 2860, 2863, 2864, 2865, 2867, 2882, 2886, 2906, 2907, 2908, 2909, 2911, 2912, 2966, 2976, 2978, 2980, 2981, 2987, 2988, 3001, 3002, 3003, 3005, 3007, 3008, 3009, 3011, 3012, 3015, 3016, 3018, 3019, 3020, 3029, 3036, 3038, 3106, 3107, 3113, 3130, 3139, 3164, 3169, 3197, 3201, 3202, 3203, 3204, 3205, 3259, 3261, 3267, 3268, 3269, 3270, 3271, 3272, 3283, 3284, 3302, 3373, 3377, 3410, 3415, 3417, 3418, 3419, 3425, 3426, 3434, 3435, 3443, 3451, 3455, 3456, 3457, 3458, 3459, 3460, 3465, 3467, 3468, 3547, 3553, 3555, 3556, 3557, 3576, 3594, 3595, 3596, 3599, 3601, 3602, 3603, 3605, 3608, 3609, 3633, 3634, 3638, 3642, 3652, 3653, 3655, 3656, or 3657, or a nucleic acid sequence thereof having 1 or 2 nucleoside substitutions, additions, or deletions. In some embodiments, the sense strand comprises the nucleoside sequence of any one of SEQ ID NOs: 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, or 1784, or a nucleic acid sequence thereof having 1 or 2 nucleoside substitutions, additions, or deletions. In some embodiments, the antisense strand comprises the nucleoside sequence of any one of SEQ ID NOs: 1887, 1888, 1889, 1890, 1910, 2126, 2134, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2338, 2371, 2373, 2374, 2419, 2474, 2489, 2491, 2494, 2684, 2695, 2696, 2697, 2698, 2704, 2725, 2726, 2730, 2741, 2742, 2748, 2756, 2799, 2855, 2856, 2859, 2987, 2988, 3003, 3005, 3007, 3008, 3009, 3011, 3012, 3015, 3016, 3018, 3019, 3020, 3169, 3197, 3201, 3202, 3283, 3284, 3425, 3426, 3465, 3634, or 3638, or a nucleic acid sequence thereof having 1 or 2 nucleoside substitutions, additions, or deletions. In some embodiments, the antisense strand comprises a seed region that is not identical to a seed region of a human miRNA. In some embodiments, the sense strand comprises the nucleoside sequence of any one of SEQ ID NOs: 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, or 1803, or 3638, or a nucleic acid sequence thereof having 1 or 2 nucleoside substitutions, additions, or deletions. In some embodiments, the antisense strand comprises the nucleoside sequence of any one of SEQ ID NOs: 1886, 1890, 1910, 1911, 1912, 1915, 1916, 1933, 1934, 1971, 1973, 1979, 1980, 1982, 2003, 2006, 2011, 2012, 2013, 2015, 2019, 2020, 2021, 2022, 2023, 2028, 2050, 2065, 2066, 2071, 2072, 2073, 2084, 2085, 2099, 2100, 2107, 2114, 2115, 2116, 2125, 2126, 2134, 2143, 2145, 2146, 2147, 2158, 2175, 2177, 2179, 2180, 2182, 2184, 2185, 2186, 2187, 2188, 2191, 2192, 2196, 2201, 2203, 2206, 2207, 2210, 2234, 2236, 2240, 2242, 2245, 2246, 2248, 2253, 2267, 2268, 2269, 2276, 2277, 2278, 2279, 2280, 2289, 2371, 2373, 2374, 2419, 2425, 2461, 2462, 2466, 2471, 2474, 2489, 2494, 2526, 2527, 2528, 2529, 2532, 2533, 2535, 2537, 2538, 2541, 2546, 2696, 2697, 2704, 2705, 2708, 2720, 2722, 2730, 2746, 2747, 2756, 2765, 2766, 2767, 2768, 2770, 2773, 2799, 2855, 2856, 2860, 2864, 2882, 2906, 2907, 2908, 2909, 2911, 2966, 2978, 2981, 3001, 3003, 3005, 3007, 3009, 3011, 3018, 3029, 3036, 3038, 3113, 3130, 3139, 3169, 3197, 3203, 3204, 3205, 3259, 3261, 3267, 3269, 3272, 3418, 3425, 3435, 3443, 3451, 3455, 3456, 3457, 3458, 3459, 3460, 3467, 3468, 3547, 3555, 3576, 3594, 3599, 3605, 3609, 3655, 3656, or 3657, or a nucleic acid sequence thereof having 1 or 2 nucleoside substitutions, additions, or deletions. In some embodiments, the sense strand comprises the nucleoside sequence of any one of SEQ ID 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, or 1571, or a nucleic acid sequence thereof having 1 or 2 nucleoside substitutions, additions, or deletions. In some embodiments, the antisense strand comprises the nucleoside sequence of any one of SEQ ID 1890, 1910, 2126, 2134, 2143, 2145, 2146, 2147, 2175, 2177, 2180, 2182, 2184, 2185, 2186, 2187, 2188, 2191, 2192, 2196, 2201, 2203, 2289, 2371, 2373, 2374, 2419, 2474, 2489, 2494, 2696, 2697, 2704, 2730, 2756, 2799, 2855, 2856, 3003, 3005, 3007, 3009, 3011, 3018, 3169, 3197, or 3425, or a nucleic acid sequence thereof having 1 or 2 nucleoside substitutions, additions, or deletions. In some embodiments, the sense strand comprises a seed region that is not identical to a seed region of a human miRNA. In some embodiments, the sense strand comprises the nucleoside sequence of any one of SEQ ID NOs: 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, or 1787, or a nucleic acid sequence thereof having 1 or 2 nucleoside substitutions, additions, or deletions. In some embodiments, the antisense strand comprises the nucleoside sequence of any one of SEQ ID NOs: 1886, 1890, 1910, 1912, 1915, 1916, 1934, 1971, 1973, 1980, 2006, 2008, 2011, 2012, 2013, 2015, 2020, 2023, 2028, 2031, 2050, 2065, 2066, 2071, 2072, 2084, 2085, 2099, 2107, 2114, 2115, 2125, 2126, 2134, 2143, 2147, 2158, 2182, 2184, 2185, 2186, 2187, 2188, 2191, 2196, 2201, 2203, 2207, 2210, 2240, 2242, 2245, 2246, 2248, 2268, 2269, 2276, 2277, 2278, 2280, 2289, 2374, 2425, 2462, 2466, 2471, 2507, 2526, 2532, 2533, 2535, 2537, 2546, 2696, 2697, 2705, 2708, 2713, 2730, 2746, 2754, 2767, 2768, 2773, 2822, 2855, 2856, 2908, 2911, 2918, 2966, 2978, 3011, 3018, 3036, 3038, 3102, 3113, 3197, 3205, 3206, 3269, 3272, 3418, 3435, 3456, 3468, 3547, 3555, 3576, 3594, 3605, 3609, or 3641, or a nucleic acid sequence thereof having 1 or 2 nucleoside substitutions, additions, or deletions. In some embodiments, the sense strand comprises the nucleoside sequence of any one of SEQ ID NOs: 36, 56, 272, 280, 289, 293, 328, 330, 331, 332, 333, 334, 337, 342, 347, 349, 435, 520, 842, 843, 876, 1001, 1002, 1157, 1164, or 1343, or a nucleic acid sequence thereof having 1 or 2 nucleoside substitutions, additions, or deletions. In some embodiments, the antisense strand comprises the nucleoside sequence of any one of SEQ ID NOs: 1890, 1910, 2126, 2134, 2143, 2147, 2182, 2184, 2185, 2186, 2187, 2188, 2191, 2196, 2201, 2203, 2289, 2374, 2696, 2697, 2730, 2855, 2856, 3011, 3018, or 3197, or a nucleic acid sequence thereof having 1 or 2 nucleoside substitutions, additions, or deletions. In some embodiments, the sense strand and/or the antisense strand further comprise a 3' overhang comprising 1, 2, or more nucleosides. In some embodiments, the 3' overhang comprises 2 nucleosides. In some embodiments, (i) the oligonucleotide comprises a modification comprising a modified nucleoside and/or a modified internucleoside linkage, and/or (ii) the composition comprises a pharmaceutically acceptable carrier. In some embodiments, the oligonucleotide comprises a modification comprising a modified nucleoside and/or a modified internucleoside linkage. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages. In some embodiments, the oligonucleotide comprises the modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises one or more 2'fluoro modified nucleosides. In some embodiments, the modified nucleoside comprises a 2' O-alkyl modified nucleoside. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the oligonucleotide comprises an N-acetylgalactosamine (GalNAc) ligand for hepatocyte targeting. In some embodiments, the oligonucleotide comprises 1, 2, 3, 4, 5, 6, 7, 8, 9, 10, 11, 12, 13, 14, 15, 16, 17, 18, 19, 20, or 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides. In some embodiments, the sense strand comprises modification pattern 1S. In some embodiments, the sense strand comprises modification pattern 2S. In some embodiments, the sense strand comprises modification pattern 3S. In some embodiments, the sense strand comprises modification pattern 4S. In some embodiments, the sense strand comprises modification pattern 5S. In some embodiments, the sense strand comprises modification pattern 6S. In some Any of modification patterns 1S-6S may include a GalNAc ligand at the 5' or 3' end. In some embodiments, the antisense strand comprises modification pattern 1AS. In some embodiments, the antisense strand comprises modification pattern 2AS. In some embodiments, the antisense strand comprises modification pattern 3AS. In some embodiments, the antisense strand comprises modification pattern 4AS. In some embodiments, the antisense strand comprises modification pattern 5AS. In some embodiments, the antisense strand comprises modification pattern 6AS. In some embodiments, the antisense strand comprises modification pattern 7AS. In some embodiments, the antisense strand comprises modification pattern 8AS. In some embodiments, the antisense strand comprises modification pattern 9AS. Any of modification patterns 1AS-9AS may include a GalNAc ligand at the 5' or 3' end. In some embodiments, the sense strand comprises modification pattern 1S and the antisense strand comprises modification pattern 1AS, 2AS, 3AS, 4AS, 5AS, 6AS, 7AS, 8AS, or 9AS. In some embodiments, the sense strand comprises modification pattern 2S and the antisense strand comprises modification pattern 1AS, 2AS, 3AS, 4AS, 5AS, 6AS, 7AS, 8AS, or 9AS. In some embodiments, the sense strand comprises modification pattern 3S and the antisense strand comprises modification pattern 1AS, 2AS, 3AS, 4AS, 5AS, 6AS, 7AS, 8AS, or 9AS. In some embodiments, the sense strand comprises modification pattern 4S and the antisense strand comprises modification pattern 1AS, 2AS, 3AS, 4AS, 5AS, 6AS, 7AS, 8AS, or 9AS. In some embodiments, the sense strand comprises modification pattern 5S and the antisense strand comprises modification pattern 1AS, 2AS, 3AS, 4AS, 5AS, 6AS, 7AS, 8AS, or 9AS. In some embodiments, the sense strand comprises modification pattern 6S and the antisense strand comprises modification pattern 1AS, 2AS, 3AS, 4AS, 5AS, 6AS, 7AS, 8AS, or 9AS. In some embodiments, the sense strand comprises a nucleoside sequence comprising or consisting the sequence of any one of SEQ ID NOs: 1-1854 or 13970-13977, or a nucleic acid sequence thereof having 1 or 2 nucleoside substitutions, additions, or deletions, and modification pattern 1S. In some embodiments, the sense strand comprises a nucleoside sequence comprising or consisting of the sequence of any one of SEQ ID NOs: 1-1854 or 13970-13977, and modification pattern 1S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2S. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 1AS. In some embodiments, the antisense strand comprises a nucleoside sequence comprising or consisting of the sequence of any one of SEQ ID NOs: 1855-3708 or 13978-13985, and modification pattern 1AS. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 3AS. In some embodiments, the antisense strand comprises a nucleoside sequence comprising or consisting of the sequence of any one of SEQ ID NOs: 1855-3708 or 13978-13985, and modification pattern 3AS. In some embodiments, the oligonucleotide comprises an ASO. In some embodiments, the ASO is 12-30 nucleosides in length. Also disclosed herein are compositions comprising an oligonucleotide that inhibits the expression of ANGPTL4, wherein the oligonucleotide comprises an antisense oligonucleotide (ASO) about 12-30 nucleosides in length and comprising a nucleoside sequence complementary to about 12-30 contiguous nucleosides of SEQ ID NO: 13935; wherein (i) the oligonucleotide comprises a modification comprising a modified nucleoside and/or a modified internucleoside linkage, and/or (ii) the composition comprises a pharmaceutically acceptable carrier. Also disclosed herein are compositions comprising an oligonucleotide that inhibits the expression of ANGPTL4, wherein the oligonucleotide comprises an ASO about 12-30 nucleosides in length and comprising a nucleoside sequence complementary to about 12-30 contiguous nucleosides of SEQ ID NO: 13936; wherein (i) the oligonucleotide comprises a modification comprising a modified nucleoside and/or a modified internucleoside linkage, and/or (ii) the composition comprises a pharmaceutically acceptable carrier. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 3709-13934. In some embodiments, the ASO comprises modification pattern: 5'-nsnsnsnsnsdNsdNsdNsdNsdNsdNsdNsdNsdNsnsn-snsnsn-3' where "dN" is any deoxynucleotide, "n" is a 2'O-methyl or 2'O-methoxyethyl-modified nucleoside, and "s" is a phosphorothioate linkage. In some embodiments, the ASO comprises one or more of a locked nucleic acid (LNA) or a 2',4' constrained ethyl nucleic acid. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions, and modification pattern ASO1. In some embodiments, the ASO comprises a nucleoside sequence comprising or consisting of the sequence of any one of SEQ ID NOs: 3709-13934, and modification pattern ASO1. In some embodiments, the composition is a pharmaceutical composition. In some embodiments, the composition is sterile. Some embodiments comprise a pharmaceutically acceptable carrier. In some embodiments, the pharmaceutically acceptable carrier comprises water, a buffer, or a saline solution.

Disclosed herein are methods of treating a cardiometabolic disorder in a subject in need thereof, the method comprising administering to the subject a composition comprising an oligonucleotide that targets ANGPTL4. In some embodiments, the cardiometabolic disorder comprises a cardiovascular disorder. In some embodiments, the cardiometabolic disorder comprises a metabolic disorder. Also disclosed herein are methods of treating a metabolic disorder in a subject in need thereof, the method comprising administering to the subject a composition comprising an oligonucleotide that targets ANGPTL4. In some embodiments, the metabolic disorder comprises hyperlipidemia. In some embodiments, the metabolic disorder comprises hypertriglyceridemia. In some embodiments, the metabolic disorder comprises diabetes. In some embodiments, the metabolic disorder comprises type 2 diabetes. Also disclosed herein are methods of treating a cardiovascular disorder in a subject in need thereof, the method comprising administering to the subject a composition comprising an oligonucleotide that targets ANGPTL4. In some embodiments, the cardiovascular disorder comprises heart disease. In some embodiments, the cardiovascular disorder comprises myocardial infarction. In some embodiments, the cardiovascular disorder comprises angina pectoris. In some embodiments, the cardiovascular disorder comprises atherosclerosis. In some embodiments, the subject is an animal, a mammal, a dog, a cat, cattle, a rodent, a mouse, a rat, a primate, or a monkey. In some embodiments, the subject is a human. In some embodiments, the subject is ≥40 years of age. In some embodiments, the subject is ≤85 years of age. In some embodiments, the subject is ≥40 and ≤85 years of age. In some embodiments, a baseline measurement is obtained in a sample obtained from the subject prior to administering the composition to the subject. In some embodiments, the baseline measurement is a baseline triglyceride measurement. In some embodiments, the baseline measurement is a baseline cholesterol measurement. In some embodiments, the baseline measurement is a baseline HDL measurement. In some embodiments, the baseline measurement is a baseline glucose measurement. In some embodiments, the baseline measurement is a baseline insulin measurement. In some embodiments, the baseline measurement is a baseline ANGPTL4 protein measurement. In some embodiments, the sample is a blood, plasma, or serum sample. In some embodiments, the sample is a serum sample. In some embodiments, the baseline measurement is obtained by an immunoassay, a colorimetric assay, or a fluorescence assay. In some embodiments, the baseline measurement is a baseline ANGPTL4 mRNA measurement. In some embodiments, the sample is a tissue sample. In some embodiments, the tissue sample comprises liver, adipose, small intestine, mesenteric lymph node, or cardiac tissue. In some embodiments, the tissue sample is a liver sample. In some embodiments, the baseline measurement is obtained by PCR. In some embodiments, the sample is obtained from the subject after an overnight fasting period. In some embodiments, the sample is obtained from the subject in a fed state. In some embodiments, the composition reduces circulating triglycerides relative to the baseline triglyceride measurement. In some embodiments, the reduced triglycerides are measured in a second sample obtained from the subject after administering the composition to the subject. In some embodiments, the composition reduces circulating cholesterol relative to the baseline cholesterol measurement. In some embodiments, the reduced cholesterol is measured in a second sample obtained from the subject after administering the composition to the subject. In some embodiments, the composition increases circulating HDL relative to the baseline HDL measurement. In some embodiments, the increased HDL is measured in a second sample obtained from the subject after administering the composition to the subject. In some embodiments, the composition reduces circulating glucose relative to the baseline glucose measurement. In some embodiments, the reduced glucose is measured in a second sample obtained from the subject after administering the composition to the subject. In some embodiments, the composition reduces circulating ANGPTL4 protein levels relative to the baseline ANGPTL4 protein measurement. In some embodiments, the reduced ANGPTL4 protein levels are measured in a second sample obtained from the subject after administering the composition to the subject. In some embodiments, the composition reduces ANGPTL4 mRNA levels relative to the baseline ANGPTL4 mRNA measurement. In some embodiments, the reduced ANGPTL4 mRNA levels are measured in a second sample obtained from the subject after administering the composition to the subject. In some embodiments, the oligonucleotide comprises an siRNA comprising a sense strand and an antisense strand. In some embodiments, the sense strand is 14-30 nucleosides in length. In some embodiments, the antisense strand is 14-30 nucleosides in length. In some embodiments, the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13935. In some embodiments, the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13936. In some embodiments, the sense strand and the antisense strand form a double-stranded RNA duplex. In some embodiments, the first base pair of the double-stranded RNA duplex is an AU base pair. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 1-1854 or 13970-13977. In some embodiments, the sense strand further comprises a 3' overhang comprising 1, 2, or more nucleosides. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions. In some embodiments, the antisense strand comprises a nucleoside sequence comprising or consisting of the sequence of any one of SEQ ID NOs: 1855-3708 or 13978-13985. In some embodiments, the antisense strand further comprises a 3' overhang comprising 1, 2, or more nucleosides. In some embodiments, the siRNA binds with a 19mer in a human ANGPTL4 mRNA. In some embodiments, the siRNA binds with a 17mer in a non-human primate ANGPTL4 mRNA. In some embodiments, the siRNA binds with a 19mer in a human ANGPTL4 mRNA. In some embodiments, the siRNA binds with a human ANGPTL4 mRNA and less than or equal to 20 human off-targets, with no more than 2 mismatches in the antisense strand. In some embodiments, siRNA binds with a human ANGPTL4 mRNA target site that does not harbor an SNP, with a minor allele frequency (MAF) greater or equal to 1% (pos. 2-18). In some embodiments, the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside substitutions, additions, or deletions; and/or the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside substitutions, additions, or deletions. In some embodiments, the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803; and/or the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657. In some embodiments, the sense strand comprises the nucleoside sequence of any one of SEQ ID NOs: 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, or 1787, or a nucleic acid sequence thereof having 1 or 2 nucleoside substitutions, additions, or deletions. In some embodiments, the antisense strand comprises the nucleoside sequence of any one of SEQ ID NOs: 1887, 1888, 1889, 1890, 1910, 1975, 2126, 2134, 2136, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2335, 2338, 2363, 2371, 2373, 2374, 2419, 2474, 2489, 2491, 2494, 2684, 2688, 2695, 2696, 2697, 2698, 2704, 2725, 2726, 2730, 2741, 2742, 2748, 2751, 2756, 2799, 2855, 2856, 2859, 2891, 2987, 2988, 2991, 3003, 3005, 3007, 3008, 3009, 3011, 3012, 3015, 3016, 3018, 3019, 3020, 3025, 3026, 3102, 3103, 3169, 3192, 3197, 3201, 3202, 3283, 3284, 3424, 3425, 3426, 3464, 3465, 3471, 3634, 3638, or 3641, or a nucleic acid sequence thereof having 1 or 2 nucleoside substitutions, additions, or deletions. In some embodiments, the sense strand comprises the nucleoside sequence of any one of SEQ ID NOs: 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, or 1803, or a nucleic acid sequence thereof having 1 or 2 nucleoside substitutions, additions, or deletions. In some embodiments, the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1966, 1970, 1971, 1972, 1973, 1974, 1979, 1980, 1981, 1982, 1983, 2003, 2004, 2006, 2007, 2011, 2012, 2013, 2015, 2018, 2019, 2020, 2021, 2022, 2023, 2026, 2028, 2029, 2050, 2053, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2234, 2236, 2240, 2242, 2245, 2246, 2247, 2248, 2251, 2252, 2253, 2256, 2258, 2259, 2265, 2266, 2267, 2268, 2269, 2274, 2275, 2276, 2277, 2278, 2279, 2280, 2281, 2282, 2283, 2284, 2285, 2289, 2338, 2371, 2373, 2374, 2419, 2424, 2425, 2426, 2461, 2462, 2464, 2465, 2466, 2470, 2471, 2474, 2489, 2491, 2494, 2526, 2527, 2528, 2529, 2530, 2531, 2532, 2533, 2535, 2536, 2537, 2538, 2540, 2541, 2543, 2546, 2549, 2684, 2695, 2696, 2697, 2698, 2704, 2705, 2706, 2707, 2708, 2710, 2711, 2720, 2722, 2725, 2726, 2730, 2741, 2742, 2744, 2746, 2747, 2748, 2756, 2765, 2766, 2767, 2768, 2769, 2770, 2771, 2772, 2773, 2774, 2775, 2776, 2799, 2855, 2856, 2859, 2860, 2863, 2864, 2865, 2867, 2882, 2886, 2906, 2907, 2908, 2909, 2911, 2912, 2966, 2976, 2978, 2980, 2981, 2987, 2988, 3001, 3002, 3003, 3005, 3007, 3008, 3009, 3011, 3012, 3015, 3016, 3018, 3019, 3020, 3029, 3036, 3038, 3106, 3107, 3113, 3130, 3139, 3164, 3169, 3197, 3201, 3202, 3203, 3204, 3205, 3259, 3261, 3267, 3268, 3269, 3270, 3271, 3272, 3283, 3284, 3302, 3373, 3377, 3410, 3415, 3417, 3418, 3419, 3425, 3426, 3434, 3435, 3443, 3451, 3455, 3456, 3457, 3458, 3459, 3460, 3465, 3467, 3468, 3547, 3553, 3555, 3556, 3557, 3576, 3594, 3595, 3596, 3599, 3601, 3602, 3603, 3605, 3608, 3609, 3633, 3634, 3638, 3642, 3652, 3653, 3655, 3656, or 3657, or a nucleic acid sequence thereof having 1 or 2 nucleoside substitutions, additions, or deletions. In some embodiments, the sense strand comprises the nucleoside sequence of any one of SEQ ID NOs: 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, or 1784, or a nucleic acid sequence thereof having 1 or 2 nucleoside substitutions, additions, or deletions. In some embodiments, the antisense strand comprises the nucleoside sequence of any one of SEQ ID NOs: 1887, 1888, 1889, 1890, 1910, 2126, 2134, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2338, 2371, 2373, 2374, 2419, 2474, 2489, 2491, 2494, 2684, 2695, 2696, 2697, 2698, 2704, 2725, 2726, 2730, 2741, 2742, 2748, 2756, 2799, 2855, 2856, 2859, 2987, 2988, 3003, 3005, 3007, 3008, 3009, 3011, 3012, 3015, 3016, 3018, 3019, 3020, 3169, 3197, 3201, 3202, 3283, 3284, 3425, 3426, 3465, 3634, or 3638. In some embodiments, the antisense strand comprises a seed region that is not identical to a seed region of a human miRNA. In some embodiments, the sense strand comprises the nucleoside sequence of any one of SEQ ID NOs: 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, or 1803, or 3638, or a nucleic acid sequence thereof having 1 or 2 nucleoside substitutions, additions, or deletions. In some embodiments, the antisense strand comprises the nucleoside sequence of any one of SEQ ID NOs: 1886, 1890, 1910, 1911, 1912, 1915, 1916, 1933, 1934, 1971, 1973, 1979, 1980, 1982, 2003, 2006, 2011, 2012, 2013, 2015, 2019, 2020, 2021, 2022, 2023, 2028, 2050, 2065, 2066, 2071, 2072, 2073, 2084, 2085, 2099, 2100, 2107, 2114, 2115, 2116, 2125, 2126, 2134, 2143, 2145, 2146, 2147, 2158, 2175, 2177, 2179, 2180, 2182, 2184, 2185, 2186, 2187, 2188, 2191, 2192, 2196, 2201, 2203, 2206, 2207, 2210, 2234, 2236, 2240, 2242, 2245, 2246, 2248, 2253, 2267, 2268, 2269, 2276, 2277, 2278, 2279, 2280, 2289, 2371, 2373, 2374, 2419, 2425, 2461, 2462, 2466, 2471, 2474, 2489, 2494, 2526, 2527, 2528, 2529, 2532, 2533, 2535, 2537, 2538, 2541, 2546, 2696, 2697, 2704, 2705, 2708, 2720, 2722, 2730, 2746, 2747, 2756, 2765, 2766, 2767, 2768, 2770, 2773, 2799, 2855, 2856, 2860, 2864, 2882, 2906, 2907, 2908, 2909, 2911, 2966, 2978, 2981, 3001, 3003, 3005, 3007, 3009, 3011, 3018, 3029, 3036, 3038, 3113, 3130, 3139, 3169, 3197, 3203, 3204, 3205, 3259, 3261, 3267, 3269, 3272, 3418, 3425, 3435, 3443, 3451, 3455, 3456, 3457, 3458, 3459, 3460, 3467, 3468, 3547, 3555, 3576, 3594, 3599, 3605, 3609, 3655, 3656, or 3657, or a nucleic acid sequence thereof having 1 or 2 nucleoside substitutions, additions, or deletions. In some embodiments, the sense strand comprises the nucleoside sequence of any one of SEQ ID 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, or 1571, or a nucleic acid sequence thereof having 1 or 2 nucleoside substitutions, additions, or deletions. In some embodiments, the antisense strand comprises the nucleoside sequence of any one of SEQ ID 1890, 1910, 2126, 2134, 2143, 2145, 2146, 2147, 2175, 2177, 2180, 2182, 2184, 2185, 2186, 2187, 2188, 2191, 2192, 2196, 2201, 2203, 2289, 2371, 2373, 2374, 2419, 2474, 2489, 2494, 2696, 2697, 2704, 2730, 2756, 2799, 2855, 2856, 3003, 3005, 3007, 3009, 3011, 3018, 3169, 3197, or 3425, or a nucleic acid sequence thereof having 1 or 2 nucleoside substitutions, additions, or deletions. In some embodiments, the sense strand comprises a seed region that is not identical to a seed region of a human miRNA. In some embodiments, the sense strand comprises the nucleoside sequence of any one of SEQ ID NOs: 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, or 1787, or a nucleic acid sequence thereof having 1 or 2 nucleoside substitutions, additions, or deletions. In some embodiments, the antisense strand comprises the nucleoside sequence of any one of SEQ ID NOs: 1886, 1890, 1910, 1912, 1915, 1916, 1934, 1971, 1973, 1980, 2006, 2008, 2011, 2012, 2013, 2015, 2020, 2023, 2028, 2031, 2050, 2065, 2066, 2071, 2072, 2084, 2085, 2099, 2107, 2114, 2115, 2125, 2126, 2134, 2143, 2147, 2158, 2182, 2184, 2185, 2186, 2187, 2188, 2191, 2196, 2201, 2203, 2207, 2210, 2240, 2242, 2245, 2246, 2248, 2268, 2269, 2276, 2277, 2278, 2280, 2289, 2374, 2425, 2462, 2466, 2471, 2507, 2526, 2532, 2533, 2535, 2537, 2546, 2696, 2697, 2705, 2708, 2713, 2730, 2746, 2754, 2767, 2768, 2773, 2822, 2855, 2856, 2908, 2911, 2918, 2966, 2978, 3011, 3018, 3036, 3038, 3102, 3113, 3197, 3205, 3206, 3269, 3272, 3418, 3435, 3456, 3468, 3547, 3555, 3576, 3594, 3605, 3609, or 3641, or a nucleic acid sequence thereof having 1 or 2 nucleoside substitutions, additions, or deletions. In some embodiments, the sense strand comprises the nucleoside sequence of any one of SEQ ID NOs: 36, 56, 272, 280, 289, 293, 328, 330, 331, 332, 333, 334, 337, 342, 347, 349, 435, 520, 842, 843, 876, 1001, 1002, 1157, 1164, or 1343, or a nucleic acid sequence thereof having 1 or 2 nucleoside substitutions, additions, or deletions. In some embodiments, the antisense strand comprises the nucleoside sequence of any one of SEQ ID NOs: 1890, 1910, 2126, 2134, 2143, 2147, 2182, 2184, 2185, 2186, 2187, 2188, 2191, 2196, 2201, 2203, 2289, 2374, 2696, 2697, 2730, 2855, 2856, 3011, 3018, or 3197, or a nucleic acid sequence thereof having 1 or 2 nucleoside substitutions, additions, or deletions. In some embodiments, the sense strand and/or the antisense strand further comprise a 3' overhang comprising 1, 2, or more nucleosides. In some embodiments, the 3' overhang comprises 2 nucleosides. In some embodiments, (i) the oligonucleotide comprises a modification comprising a modified nucleoside and/or a modified internucleoside linkage, and/or (ii) the composition comprises a pharmaceutically acceptable carrier. In some embodiments, the oligonucleotide comprises a modification comprising a modified nucleoside and/or a modified internucleoside linkage. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. In some embodiments, the oligonucleotide comprises 1, 2, 3, 4, 5, 6, 7, 8, 9, 10, 11, 12, 13, 14, 15, 16, 17, 18, 19, or 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages. In some embodiments, the oligonucleotide comprises the modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises one or more 2'fluoro modified nucleosides. In some embodiments, the modified nucleoside comprises a 2' O-alkyl modified nucleoside. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the oligonucleotide comprises an N-acetylgalactosamine (GalNAc) ligand for hepatocyte targeting. In some embodiments, the oligonucleotide comprises 1, 2, 3, 4, 5, 6, 7, 8, 9, 10, 11, 12, 13, 14, 15, 16, 17, 18, 19, 20, or 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides. In some embodiments, the sense strand comprises modification pattern 1S. In some embodiments, the sense strand comprises modification pattern 2S. In some embodiments, the sense strand comprises modification pattern 3S. In some embodiments, the sense strand comprises modification pattern 4S. In some embodiments, the sense strand comprises modification pattern 5S. In some embodiments, the sense strand comprises modification pattern 6S. In some Any of modification patterns 1S-6S may include a GalNAc ligand at the 5' or 3' end. In some embodiments, the antisense strand comprises modification pattern 1AS. In some embodiments, the antisense strand comprises modification pattern 2AS. In some embodiments, the antisense strand comprises modification pattern 3AS. In some embodiments, the antisense strand comprises modification pattern 4AS. In some embodiments, the antisense strand comprises modification pattern 5AS. In some embodiments, the antisense strand comprises modification pattern 6AS. In some embodiments, the antisense strand comprises modification pattern 7AS. In some embodiments, the antisense strand comprises modification pattern 8AS. In some embodiments, the antisense strand comprises modification pattern 9AS. Any of modification patterns 1AS-9AS may include a GalNAc ligand at the 5' or 3' end. In some embodiments, the sense strand comprises modification pattern 15 and the antisense strand comprises modification pattern 1AS, 2AS, 3AS, 4AS, 5AS, 6AS, 7AS, 8AS, or 9AS. In some embodiments, the sense strand comprises modification pattern 2S and the antisense strand comprises modification pattern 1AS, 2AS, 3AS, 4AS, 5AS, 6AS, 7AS, 8AS, or 9AS. In some embodiments, the sense strand comprises modification pattern 3S and the antisense strand comprises modification pattern 1AS, 2AS, 3AS, 4AS, 5AS, 6AS, 7AS, 8AS, or 9AS. In some embodiments, the sense strand comprises modification pattern 4S and the antisense strand comprises modification pattern 1AS, 2AS, 3AS, 4AS, 5AS, 6AS, 7AS, 8AS, or 9AS. In some embodiments, the sense strand comprises modification pattern 5S and the antisense strand comprises modification pattern 1AS, 2AS, 3AS, 4AS, 5AS, 6AS, 7AS, 8AS, or 9AS. In some embodiments, the sense strand comprises modification pattern 6S and the antisense strand comprises modification pattern 1AS, 2AS, 3AS, 4AS, 5AS, 6AS, 7AS, 8AS, or 9AS. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 1S. In some embodiments, the sense strand comprises a nucleoside sequence comprising or consisting of the sequence of any one of SEQ ID NOs: 1-1854 or 13970-13977, and modification pattern 15. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2S. In some embodiments, the sense strand comprises a nucleoside sequence comprising or consisting of the sequence of any one of SEQ ID NOs: 1-1854 or 13970-13977, and modification pattern 2S. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 1AS. In some embodiments, the antisense strand comprises a nucleoside sequence comprising or consisting of the sequence of any one of SEQ ID NOs: 1855-3708 or 13978-13985, and modification pattern 1AS. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 3AS. In some embodiments, the antisense strand comprises a nucleoside sequence comprising or consisting of the sequence of any one of SEQ ID NOs: 1855-3708 or 13978-13985, and modification pattern 3AS. In some embodiments, the oligonucleotide comprises an ASO. In some embodiments, the ASO is 12-30 nucleosides in length. In some embodiments, the oligonucleotide comprises an antisense oligonucleotide (ASO) about 12-30 nucleosides in length and comprising a nucleoside sequence complementary to about 12-30 contiguous nucleosides of SEQ ID NO: 13935; wherein (i) the oligonucleotide comprises a modification comprising a modified nucleoside and/or a modified internucleoside linkage, and/or (ii) the composition comprises a pharmaceutically acceptable carrier. In some embodiments, the oligonucleotide comprises an ASO about 12-30 nucleosides in length and comprising a nucleoside sequence complementary to about 12-30 contiguous nucleosides of SEQ ID NO: 13936; wherein (i) the oligonucleotide comprises a modification comprising a modified nucleoside and/or a modified internucleoside linkage, and/or (ii) the composition comprises a pharmaceutically acceptable carrier. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 3709-13934. In some embodiments, the ASO comprises modification pattern: 5'-nsnsnsnsnsdNsdNsdNsdNsdNsdNsdNsdNsdNsdNsnsn-snsnsn-3' where "dN" is any deoxynucleotide, "n" is a 2'O-methyl or 2'O-methoxyethyl-modified nucleoside, and "s" is a phosphorothioate linkage. In some embodiments, the ASO comprises one or more of a locked nucleic acid (LNA) or a 2',4' constrained ethyl nucleic acid. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions, and modification pattern ASO1. In some embodiments, the ASO comprises a nucleoside sequence comprising or consisting of the sequence of any one of SEQ ID NOs: 3709-13934, and modification pattern ASO1. In some embodiments, the composition is a pharmaceutical composition. In some embodiments, the composition is sterile. In some embodiments, the composition comprises a pharmaceutically acceptable carrier. In some embodiments, the pharmaceutically acceptable carrier comprises water, a buffer, or a saline solution.

DETAILED DESCRIPTION

Large-scale human genetic data can improve the success rate of pharmaceutical discovery and development. A Genome Wide Association Study (GWAS) may detect associations between genetic variants and traits in a population sample. A GWAS may enable better understanding of the biology of disease, and provide applicable treatments. A GWAS can utilize genotyping and/or sequencing data, and often involves an evaluation of millions of genetic variants that are relatively evenly distributed across the genome. The most common GWAS design is the case-control study, which involves comparing variant frequencies in cases versus controls. If a variant has a significantly different frequency in cases versus controls, that variant is said to be associated with disease. Association statistics that may be used in a GWAS are p-values, as a measure of statistical significance; odds ratios (OR), as a measure of effect size; or beta coefficients (beta), as a measure of effect size. Researchers often assume an additive genetic model and calculate an allelic odds ratio, which is the increased (or decreased) risk of disease conferred by each additional copy of an allele (compared to carrying no copies of that allele). An additional concept in design and interpretation of GWAS is that of linkage disequilibrium, which is the non-random association of alleles. The presence of linkage disequilibrium can obfuscate which variant is "causal."

Functional annotation of variants and/or wet lab experimentation can identify the causal genetic variant identified via GWAS, and in many cases may lead to the identification of disease-causing genes. In particular, understanding the functional effect of a causal genetic variant (for example, loss of protein function, gain of protein function, increase in gene expression, or decrease in gene expression) may allow that variant to be used as a proxy for therapeutic modulation of the target gene, or to gain insight into potential therapeutic efficacy and safety of a therapeutic that modulates that target.

Identification of such gene-disease associations has provided insights into disease biology and may be used to identify novel therapeutic targets for the pharmaceutical industry. In order to translate the therapeutic insights derived from human genetics, disease biology in patients may be exogenously 'programmed' into replicating the observation from human genetics. There are several potential options for therapeutic modalities that may be brought to bear in translating therapeutic targets identified via human genetics into novel medicines. These may include well established therapeutic modalities such as small molecules and monoclonal antibodies, maturing modalities such as oligonucleotides, and emerging modalities such as gene therapy and gene editing. The choice of therapeutic modality can depend on several factors including the location of a target (for example, intracellular, extracellular, or secreted), a relevant tissue (for example, liver) and a relevant indication.

Cardiovascular and metabolic diseases are leading causes of death, accounting for about one-third of all deaths globally. Angiopoietin-like proteins (ANGPTLs) are regulators of lipoprotein metabolism and may serve as therapeutic targets for modulation of lipid levels and cardiometabolic disease risk. ANGPTLs are a family of eight proteins with some functional similarities to angiopoietins. They typically have a characteristic structure that includes an N-terminal coiled-coil domain that mediates homo-oligomerization and a C-terminal fibrinogen domain involved in signaling.

Angiopoietin-like 4 (ANGPTL4; UniProt ID Q9BY76) is an endogenous inhibitor of lipoprotein lipase (LPL), an enzyme that hydrolyzes triglycerides contained in triglyceride-rich lipoproteins (TRLs) such as chylomicrons and very low-density lipoproteins. ANGPTL4 is a secreted protein that in humans is often most highly expressed in the liver and adipose tissue. After cellular secretion, ANGPTL4 is often cleaved to 37 kD C-terminal and 15 kD N-terminal fragment, and these oligomerized N-terminal fragments inhibit LPL. In some embodiments, ANGPTL4 is glycosylated. In some embodiments, ANGPTL4 has a coiled-coil N-terminal domain. In some embodiments, ANGPTL4 has a fibrinogen-like C-terminal domain.

Circulating triglycerides are strong and independent positive predictors of cardiovascular disease risk and all-cause mortality, and are also positively correlated with plasma glucose levels, risk of diabetes, metabolic syndrome, and pancreatitis. Additionally, mutations in TRL genes may cause hereditary disorders including familial chylomicronemia syndrome and familial hypertriglyceridemia. Here, it is shown that genetic variants that cause inactivation of ANGPTL4 in humans are associated with decreased triglycerides, increased HDL and decreased risk of diabetes and cardiovascular disease. Therefore, inhibition of ANGPTL4 may serve as a therapeutic strategy for treatment of a range of cardiometabolic diseases.

Disclosed herein are compositions comprising an oligonucleotide that targets Angiopoietin-like 4 (ANGPTL4). The oligonucleotide may include a small interfering RNA (siRNA) or an antisense oligonucleotide (ASO). Also provided herein are methods of treating a metabolic or cardiovascular disorder by providing an oligonucleotide that targets ANGPTL4 to a subject in need thereof.

I. Compositions

Disclosed herein, in some embodiments, are compositions comprising an oligonucleotide. In some embodiments, the composition comprises an oligonucleotide that targets Angiopoietin-like 4 (ANGPTL4). In some embodiments, the composition consists of an oligonucleotide that targets ANGPTL4. In some embodiments, a composition described herein is used in a method of treating a disorder in a subject in need thereof. Some embodiments relate to a composition comprising an oligonucleotide for use in a method of treating a disorder as described herein. Some embodiments relate to use of a composition comprising an oligonucleotide, in a method of treating a disorder as described herein.

In some embodiments, the composition comprises an oligonucleotide that targets ANGPTL4 and when administered to a subject in an effective amount decreases ANGPTL4 mRNA levels in a cell or tissue. In some embodiments, the cell is a hepatocyte. In some embodiments, the tissue is liver or adipose tissue. In some embodiments, the ANGPTL4 mRNA levels are decreased by about 2.5% or more, about 5% or more, or about 7.5% or more, as compared to prior to administration. In some embodiments, the ANGPTL4 mRNA levels are decreased by about 10% or more, as compared to prior to administration. In some embodiments, the ANGPTL4 mRNA levels are decreased by about 20% or more, about 30% or more, about 40% or more, about 50% or more, about 60% or more, about 70% or more, about 80% or more, about 90% or more, or about 100%, as compared to prior to administration. In some embodiments, the ANGPTL4 mRNA levels are decreased by no more than about 2.5%, no more than about 5%, or no more than about 7.5%, as compared to prior to administration. In some embodiments, the ANGPTL4 mRNA levels are decreased by no more than about 10%, as compared to prior to administration. In some embodiments, the ANGPTL4 mRNA levels are decreased by no more than about 20%, no more than about 30%, no more than about 40%, no more than about 50%, no more than about 60%, no more than about 70%, no more than about 80%, or no more than about 90%, as compared to prior to administration. In some embodiments, the ANGPTL4 mRNA levels are decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the composition comprises an oligonucleotide that targets ANGPTL4 and when administered to a subject in an effective amount decreases circulating ANGPTL4 protein levels in a cell or tissue. In some embodiments, the composition comprises an oligonucleotide that targets ANGPTL4 and when administered to a subject in an effective amount decreases ANGPTL4 protein levels in a fluid such as blood, serum or plasma. In some embodiments, the ANGPTL4 protein levels are decreased by about 2.5% or more, about 5% or more, or about 7.5% or more, as compared to prior to administration. In some embodiments, the ANGPTL4 protein levels are decreased by about 10% or more, as compared to prior to administration. In some embodiments, the ANGPTL4 protein levels are decreased by about 20% or more, about 30% or more, about 40% or more, about 50% or more, about 60% or more, about 70% or more, about 80% or more, about 90% or more, or about 100%, as compared to prior to administration. In some embodiments, the ANGPTL4 protein levels are decreased by no more than about 2.5%, no more than about 5%, or no more than about 7.5%, as compared to prior to administration. In some embodiments, the ANGPTL4 protein levels are decreased by no more than about 10%, as compared to prior to administration. In some embodiments, the ANGPTL4 protein levels are decreased by no more than about 20%, no more than about 30%, no more than about 40%, no more than about 50%, no more than about 60%, no more than about 70%, no more than about 80%, or no more than about 90%, as compared to prior to administration. In some embodiments, the ANGPTL4 protein levels are decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the composition comprises an oligonucleotide that targets ANGPTL4 and when administered to a subject in an effective amount decreases circulating triglycerides. In some embodiments, the triglycerides are decreased by about 2.5% or more, about 5% or more, or about 7.5% or more, as compared to prior to administration. In some embodiments, the triglycerides are decreased by about 10% or more, as compared to prior to administration. In some embodiments, the triglycerides are decreased by about 20% or more, about 30% or more, about 40% or more, about 50% or more, about 60% or more, about 70% or more, about 80% or more, about 90% or more, or about 100%, as compared to prior to administration. In some embodiments, the triglycerides are decreased by no more than about 2.5%, no more than about 5%, or no more than about 7.5%, as compared to prior to administration. In some embodiments, the triglycerides are decreased by no more than about 10%, as compared to prior to administration. In some embodiments, the triglycerides are decreased by no more than about 20%, no more than about 30%, no more than about 40%, no more than about 50%, no more than about 60%, no more than about 70%, no more than about 80%, or no more than about 90%, as compared to prior to administration. In some embodiments, the triglycerides are decreased by 2.5%, 5%, 7.5%, 10%, 20%, 30%, 40%, 50%, 60%, 70%, 80%, 90%, or 100%, or by a range defined by any of the two aforementioned percentages.

In some embodiments the composition comprises an oligonucleotide that targets ANGPTL4 and when administered to a subject in an effective amount decreases circulating cholesterol. In some embodiments, the circulating cholesterol comprises circulating total cholesterol. In some embodiments, the circulating cholesterol is decreased by about 2.5% or more, about 5% or more, or about 7.5% or more, as compared to prior to administration. In some embodiments, the circulating cholesterol is decreased by about 10% or more, as compared to prior to administration. In some embodiments, the circulating cholesterol is decreased by about 20% or more, about 30% or more, about 40% or more, about 50% or more, about 60% or more, about 70% or more, about 80% or more, about 90% or more, or about 100%, as compared to prior to administration. In some embodiments, the cholesterol is decreased by no more than about 2.5%, no more than about 5%, or no more than about 7.5%, as compared to prior to administration. In some embodiments, the cholesterol is decreased by no more than about 10%, as compared to prior to administration. In some embodiments, the cholesterol is decreased by no more than about 20%, no more than about 30%, no more than about 40%, no more than about 50%, no more than about 60%, no more than about 70%, no more than about 80%, or no more than about 90%, as compared to prior to administration. In some embodiments, the circulating cholesterol is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the composition comprises an oligonucleotide that targets ANGPTL4 and when administered to a subject in an effective amount increases circulating high-density lipoproteins (HDL). In some embodiments, the circulating HDL are increased by about 2.5% or more, about 5% or more, or about 7.5% or more, as compared to prior to administration. In some embodiments, the circulating HDL are increased by about 10% or more, as compared to prior to administration. In some embodiments, the circulating HDL are increased by about 20% or more, about 30% or more, about 40% or more, about 50% or more, about 60% or more, about 70% or more, about 80% or more, about 90% or more, or about 100% or more as compared to prior to administration. In some embodiments, the circulating HDL are increased by about 200% or more, about 300% or more, about 400% or more, about 500% or more, about 600% or more, about 700% or more, about 800% or more, about 900% or more, or about 1000% or more, as compared to prior to administration. In some embodiments, the HDL is decreased by no more than about 2.5%, no more than about 5%, or no more than about 7.5%, as compared to prior to administration. In some embodiments, the HDL is decreased by no more than about 10%, as compared to prior to administration. In some embodiments, the HDL is decreased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the HDL is decreased by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the circulating HDL are increased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the composition comprises an oligonucleotide that targets ANGPTL4 and when administered to a subject in an effective amount decreases circulating glucose. In some embodiments, the circulating glucose is decreased by about 2.5% or more, about 5% or more, or about 7.5% or more, as compared to prior to administration. In some embodiments, the circulating glucose is decreased by about 10% or more, as compared to prior to administration. In some embodiments, the circulating glucose is decreased by about 20% or more, about 30% or more, about 40% or more, about 50% or more, about 60% or more, about 70% or more, about 80% or more, about 90% or more, or about 100%, as compared to prior to administration. In some embodiments, the glucose is decreased by no more than about 2.5%, no more than about 5%, or no more than about 7.5%, as compared to prior to administration. In some embodiments, the glucose is decreased by no more than about 10%, as compared to prior to administration. In some embodiments, the glucose is decreased by no more than about 20%, no more than about 30%, no more than about 40%, no more than about 50%, no more than about 60%, no more than about 70%, no more than about 80%, or no more than about 90%, as compared to prior to administration. In some embodiments, the circulating glucose is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the composition comprises an oligonucleotide that targets ANGPTL4 and when administered to a subject in an effective amount increases insulin sensitivity. In some embodiments, the insulin sensitivity is increased by about 2.5% or more, about 5% or more, or about 7.5% or more, as compared to prior to administration. In some embodiments, the insulin sensitivity is increased by about 10% or more, as compared to prior to administration. In some embodiments, the insulin sensitivity is increased by about 20% or more, about 30% or more, about 40% or more, about 50% or more, about 60% or more, about 70% or more, about 80% or more, about 90% or more, or about 100%, or more as compared to prior to administration. In some embodiments, the insulin sensitivity is increased by about 200% or more, about 300% or more, about 400% or more, about 500% or more, about 600% or more, about 700% or more, about 800% or more, about 900% or more, or about 1000% or more, as compared to prior to administration. In some embodiments, the insulin sensitivity is increased by no more than about 2.5%, no more than about 5%, or no more than about 7.5%, as compared to prior to administration. In some embodiments, the insulin sensitivity is increased by no more than about 10%, as compared to prior to administration. In some embodiments, the insulin sensitivity is increased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the insulin sensitivity is increased by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the insulin sensitivity is increased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the composition comprises an oligonucleotide that targets ANGPTL4 and when administered to a subject in an effective amount decreases circulating insulin. In some embodiments, the circulating insulin is decreased by about 2.5% or more, about 5% or more, or about 7.5% or more, as compared to prior to administration. In some embodiments, the circulating insulin is decreased by about 10% or more, as compared to prior to administration. In some embodiments, the circulating insulin is decreased by about 20% or more, about 30% or more, about 40% or more, about 50% or more, about 60% or more, about 70% or more, about 80% or more, about 90% or more, or about 100%, as compared to prior to administration. In some embodiments, the insulin is decreased by no more than about 2.5%, no more than about 5%, or no more than about 7.5%, as compared to prior to administration. In some embodiments, the insulin is decreased by no more than about 10%, as compared to prior to administration. In some embodiments, the insulin is decreased by no more than about 20%, no more than about 30%, no more than about 40%, no more than about 50%, no more than about 60%, no more than about 70%, no more than about 80%, or no more than about 90%, as compared to prior to administration. In some embodiments, the circulating insulin is decreased by 2.5%, 5%, 7.5%, 10%, 20%, 30%, 40%, 50%, 60%, 70%, 80%, 90%, or 100%, or by a range defined by any of the two aforementioned percentages.

A. siRNAs

In some embodiments, the composition comprises an oligonucleotide that targets Angiopoietin-like 4 (ANGPTL4), wherein the oligonucleotide comprises a small interfering RNA (siRNA). In some embodiments, the composition comprises an oligonucleotide that targets Angiopoietin-like 4 (ANGPTL4), wherein the oligonucleotide comprises a small interfering RNA (siRNA) comprising a sense strand and an antisense strand. In some embodiments, the sense strand comprises RNA. In some embodiments, the antisense strand comprises RNA.

In some embodiments, the siRNA comprises a sense strand and an antisense strand, the antisense strand being complementary with no more than 2 mismatches to a portion of a nucleic acid having the nucleoside sequence of SEQ ID NO: 13936, and each strand having 12 to 30 nucleotides. In some embodiments, the siRNA comprises a sense strand and an antisense strand, the antisense strand being complementary with no more than 2 mismatches to a portion of a nucleic acid having the nucleoside sequence of SEQ ID NO: 13935, and each strand having 12 to 30 nucleotides.

In some embodiments, the siRNA comprises a sense strand and an antisense strand, the antisense strand being 100% complementary to a portion of a nucleic acid having the nucleoside sequence of SEQ ID NO: 13936, and each strand having 12 to 30 nucleotides. In some embodiments, the siRNA comprises a sense strand and an antisense strand, the antisense strand being 100% complementary to a portion of a nucleic acid having the nucleoside sequence of SEQ ID NO: 13935, and each strand having 12 to 30 nucleotides.

In some embodiments, the composition comprises an oligonucleotide that inhibits the expression of ANGPTL4, wherein the oligonucleotide comprises an siRNA comprising a sense strand and an antisense strand, wherein the sense strand is 14-30 nucleosides in length. In some embodiments, the composition comprises a sense strange that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the composition comprises an antisense strand is 14-30 nucleosides in length. In some embodiments, the composition comprises an antisense strange that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers.

In some embodiments, the composition comprises an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of a full-length human ANGPTL4 mRNA sequence such as SEQ ID NO: 13935. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 13935.

In some embodiments, the composition comprises an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of a full-length human ANGPTL4 pre-mRNA sequence SEQ ID NO: 13936. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 13936.

In some embodiments, the composition comprises an oligonucleotide that inhibits the expression of ANGPTL4, wherein the oligonucleotide comprises an siRNA comprising a sense strand and an antisense strand, wherein the sense strand and the antisense strand form a double-stranded RNA duplex. In some embodiments, the first base pair of the double-stranded RNA duplex is an AU base pair.

In some embodiments, the composition comprises an oligonucleotide that inhibits the expression of ANGPTL4, wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions. In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside additions at the 3' end. The sequence of any one of SEQ ID NOs: 1-1854 or 13970-13977 may include sequence of any one of SEQ ID NOs: 1-1854. The sequence of any one of SEQ ID NOs: 1-1854 or 13970-13977 may include sequence of any one of SEQ ID NOs: 13970-13977.

In some embodiments, the composition comprises an oligonucleotide that inhibits the expression of ANGPTL4, wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977.

In some embodiments, the composition comprises an oligonucleotide that inhibits the expression of ANGPTL4, wherein the oligonucleotide comprises an siRNA comprising a sense strand and an antisense strand, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions. In some embodiments, the antisense strand sequence comprises a nucleoside sequence comprising or consisting of the sequence of any one of SEQ ID NOs: 1855-3708 or 13978-13985, or a nucleic acid sequence thereof having 3 or 4 nucleoside substitutions, additions, or deletions. In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides. In some embodiments, the antisense strand comprises a nucleoside sequence comprising or consisting of the sequence of any one of SEQ ID NOs: 1855-3708 or 13978-13985, or a nucleic acid sequence thereof having 1 or 2 nucleoside additions at the 3' end. The sequence of any one of SEQ ID NOs: 1855-3708 or 13978-13985 may include sequence of any one of SEQ ID NOs: 1855-3708. The sequence of any one of SEQ ID NOs: 1855-3708 or 13978-13985 may include sequence of any one of SEQ ID NOs: 13978-13985.

In some embodiments, the composition comprises an oligonucleotide that inhibits the expression of ANGPTL4, wherein the oligonucleotide comprises an siRNA comprising a sense strand and an antisense strand, wherein the antisense strand comprises a nucleoside sequence comprising or consisting of the sequence of any one of SEQ ID NOs: 1855-3708 or 13978-13985.

In some embodiments, the composition comprises an oligonucleotide that inhibits the expression of ANGPTL4, wherein the oligonucleotide comprises an siRNA comprising a sense strand and an antisense strand, wherein the siRNA binds with a 19mer in a human ANGPTL4 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in a human ANGPTL4 mRNA.

In some embodiments, the composition comprises an oligonucleotide that inhibits the expression of ANGPTL4, wherein the oligonucleotide comprises an siRNA comprising a sense strand and an antisense strand, wherein the siRNA binds with a 17mer in a non-human primate ANGPTL4 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in a non-human primate ANGPTL4 mRNA.

In some embodiments, the composition comprises an oligonucleotide that inhibits the expression of ANGPTL4, wherein the oligonucleotide comprises an siRNA comprising a sense strand and an antisense strand, wherein the siRNA binds with a 19mer in a human ANGPTL4 mRNA, or a combination thereof. In some embodiments, the siRNA binds with a 12mer, a 13mer, a 14mer, a 15mer, a 16mer, a 17mer, and 18mer, a 19mer, a 20mer, a 21mer, a 22mer, a 23mer, a 24mer, or a 25mer in a human ANGPTL4 mRNA.

In some embodiments, the composition comprises an oligonucleotide that inhibits the expression of ANGPTL4, wherein the oligonucleotide comprises an siRNA comprising a sense strand and an antisense strand, wherein the siRNA binds with a human ANGPTL4 mRNA and less than or equal to 20 human off-targets, with no more than 2 mismatches in the antisense strand. In some embodiments, the siRNA binds with a human ANGPTL4 mRNA and less than or equal to 10 human off-targets, with no more than 2 mismatches in the antisense strand. In some embodiments, the siRNA binds with a human ANGPTL4 mRNA and less than or equal to 30 human off-targets, with no more than 2 mismatches in the antisense strand. In some embodiments, the siRNA binds with a human ANGPTL4 mRNA and less than or equal to 40 human off-targets, with no more than 2 mismatches in the antisense strand. In some embodiments, the siRNA binds with a human ANGPTL4 mRNA and less than or equal to 50 human off-targets, with no more than 2 mismatches in the antisense strand. In some embodiments, the siRNA binds with a human ANGPTL4 mRNA and less than or equal to 10 human off-targets, with no more than 3 mismatches in the antisense strand. In some embodiments, the siRNA binds with a human ANGPTL4 mRNA and less than or equal to 20 human off-targets, with no more than 3 mismatches in the antisense strand. In some embodiments, the siRNA binds with a human ANGPTL4 mRNA and less than or equal to 30 human off-targets, with no more than 3 mismatches in the antisense strand. In some embodiments, the siRNA binds with a human ANGPTL4 mRNA and less than or equal to 40 human off-targets, with no more than 3 mismatches in the antisense strand. In some embodiments, the siRNA binds with a human ANGPTL4 mRNA and less than or equal to 50 human off-targets, with no more than 3 mismatches in the antisense strand.

In some embodiments, the composition comprises an oligonucleotide that inhibits the expression of ANGPTL4, wherein the oligonucleotide comprises an siRNA comprising a sense strand and an antisense strand, siRNA binds with a human ANGPTL4 mRNA target site that does not harbor an SNP, with a minor allele frequency (MAF) greater or equal to 1% (pos. 2-18). In some embodiments, the MAF is greater or equal to about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, or about 20%.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside substitutions, additions, or deletions; and/or the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside substitutions, additions, or deletions.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803; and/or the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657.

In some embodiments, the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside additions at the 3' end. In some embodiments, the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside additions at the 3' end. For example, the nucleic acid sequence may have 2 uracil nucleoside additions at the 3' end. The nucleic acid sequence may have 1 uracil nucleoside addition at the 3' end. The nucleic acid sequence may have more than 2 nucleoside additions at the 3' end.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, or 1787; and/or the antisense strand comprises the nucleoside sequence of any one of SEQ ID NOs: 1887, 1888, 1889, 1890, 1910, 1975, 2126, 2134, 2136, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2335, 2338, 2363, 2371, 2373, 2374, 2419, 2474, 2489, 2491, 2494, 2684, 2688, 2695, 2696, 2697, 2698, 2704, 2725, 2726, 2730, 2741, 2742, 2748, 2751, 2756, 2799, 2855, 2856, 2859, 2891, 2987, 2988, 2991, 3003, 3005, 3007, 3008, 3009, 3011, 3012, 3015, 3016, 3018, 3019, 3020, 3025, 3026, 3102, 3103, 3169, 3192, 3197, 3201, 3202, 3283, 3284, 3424, 3425, 3426, 3464, 3465, 3471, 3634, 3638, or 3641.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, or 1803; and/or the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1966, 1970, 1971, 1972, 1973, 1974, 1979, 1980, 1981, 1982, 1983, 2003, 2004, 2006, 2007, 2011, 2012, 2013, 2015, 2018, 2019, 2020, 2021, 2022, 2023, 2026, 2028, 2029, 2050, 2053, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2234, 2236, 2240, 2242, 2245, 2246, 2247, 2248, 2251, 2252, 2253, 2256, 2258, 2259, 2265, 2266, 2267, 2268, 2269, 2274, 2275, 2276, 2277, 2278, 2279, 2280, 2281, 2282, 2283, 2284, 2285, 2289, 2338, 2371, 2373, 2374, 2419, 2424, 2425, 2426, 2461, 2462, 2464, 2465, 2466, 2470, 2471, 2474, 2489, 2491, 2494, 2526, 2527, 2528, 2529, 2530, 2531, 2532, 2533, 2535, 2536, 2537, 2538, 2540, 2541, 2543, 2546, 2549, 2684, 2695, 2696, 2697, 2698, 2704, 2705, 2706, 2707, 2708, 2710, 2711, 2720, 2722, 2725, 2726, 2730, 2741, 2742, 2744, 2746, 2747, 2748, 2756, 2765, 2766, 2767, 2768, 2769, 2770, 2771, 2772, 2773, 2774, 2775, 2776, 2799, 2855, 2856, 2859, 2860, 2863, 2864, 2865, 2867, 2882, 2886, 2906, 2907, 2908, 2909, 2911, 2912, 2966, 2976, 2978, 2980, 2981, 2987, 2988, 3001, 3002, 3003, 3005, 3007, 3008, 3009, 3011, 3012, 3015, 3016, 3018, 3019, 3020, 3029, 3036, 3038, 3106, 3107, 3113, 3130, 3139, 3164, 3169, 3197, 3201, 3202, 3203, 3204, 3205, 3259, 3261, 3267, 3268, 3269, 3270, 3271, 3272, 3283, 3284, 3302, 3373, 3377, 3410, 3415, 3417, 3418, 3419, 3425, 3426, 3434, 3435, 3443, 3451, 3455, 3456, 3457, 3458, 3459, 3460, 3465, 3467, 3468, 3547, 3553, 3555, 3556, 3557, 3576, 3594, 3595, 3596, 3599, 3601, 3602, 3603, 3605, 3608, 3609, 3633, 3634, 3638, 3642, 3652, 3653, 3655, 3656, or 3657.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, or 1784; and/or the antisense strand comprises the nucleoside sequence of any one of SEQ ID NOs: 1887, 1888, 1889, 1890, 1910, 2126, 2134, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2338, 2371, 2373, 2374, 2419, 2474, 2489, 2491, 2494, 2684, 2695, 2696, 2697, 2698, 2704, 2725, 2726, 2730, 2741, 2742, 2748, 2756, 2799, 2855, 2856, 2859, 2987, 2988, 3003, 3005, 3007, 3008, 3009, 3011, 3012, 3015, 3016, 3018, 3019, 3020, 3169, 3197, 3201, 3202, 3283, 3284, 3425, 3426, 3465, 3634, or 3638.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, or 1803, or 3638; and/or the antisense strand comprises the nucleoside sequence of any one of SEQ ID NOs: 1886, 1890, 1910, 1911, 1912, 1915, 1916, 1933, 1934, 1971, 1973, 1979, 1980, 1982, 2003, 2006, 2011, 2012, 2013, 2015, 2019, 2020, 2021, 2022, 2023, 2028, 2050, 2065, 2066, 2071, 2072, 2073, 2084, 2085, 2099, 2100, 2107, 2114, 2115, 2116, 2125, 2126, 2134, 2143, 2145, 2146, 2147, 2158, 2175, 2177, 2179, 2180, 2182, 2184, 2185, 2186, 2187, 2188, 2191, 2192, 2196, 2201, 2203, 2206, 2207, 2210, 2234, 2236, 2240, 2242, 2245, 2246, 2248, 2253, 2267, 2268, 2269, 2276, 2277, 2278, 2279, 2280, 2289, 2371, 2373, 2374, 2419, 2425, 2461, 2462, 2466, 2471, 2474, 2489, 2494, 2526, 2527, 2528, 2529, 2532, 2533, 2535, 2537, 2538, 2541, 2546, 2696, 2697, 2704, 2705, 2708, 2720, 2722, 2730, 2746, 2747, 2756, 2765, 2766, 2767, 2768, 2770, 2773, 2799, 2855, 2856, 2860, 2864, 2882, 2906, 2907, 2908, 2909, 2911, 2966, 2978, 2981, 3001, 3003, 3005, 3007, 3009, 3011, 3018, 3029, 3036, 3038, 3113, 3130, 3139, 3169, 3197, 3203, 3204, 3205, 3259, 3261, 3267, 3269, 3272, 3418, 3425, 3435, 3443, 3451, 3455, 3456, 3457, 3458, 3459, 3460, 3467, 3468, 3547, 3555, 3576, 3594, 3599, 3605, 3609, 3655, 3656, or 3657.

In some embodiments, the composition comprises an oligonucleotide that inhibits the expression of ANGPTL4, wherein the oligonucleotide comprises an siRNA comprising a sense strand and an antisense strand, the sense strand comprises the nucleoside sequence of any one of SEQ ID 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, or 1571; and/or the antisense strand comprises the nucleoside sequence of any one of SEQ ID 1890, 1910, 2126, 2134, 2143, 2145, 2146, 2147, 2175, 2177, 2180, 2182, 2184, 2185, 2186, 2187, 2188, 2191, 2192, 2196, 2201, 2203, 2289, 2371, 2373, 2374, 2419, 2474, 2489, 2494, 2696, 2697, 2704, 2730, 2756, 2799, 2855, 2856, 3003, 3005, 3007, 3009, 3011, 3018, 3169, 3197, or 3425.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, or 1787; and/or the antisense strand comprises the nucleoside sequence of any one of SEQ ID NOs: 1886, 1890, 1910, 1912, 1915, 1916, 1934, 1971, 1973, 1980, 2006, 2008, 2011, 2012, 2013, 2015, 2020, 2023, 2028, 2031, 2050, 2065, 2066, 2071, 2072, 2084, 2085, 2099, 2107, 2114, 2115, 2125, 2126, 2134, 2143, 2147, 2158, 2182, 2184, 2185, 2186, 2187, 2188, 2191, 2196, 2201, 2203, 2207, 2210, 2240, 2242, 2245, 2246, 2248, 2268, 2269, 2276, 2277, 2278, 2280, 2289, 2374, 2425, 2462, 2466, 2471, 2507, 2526, 2532, 2533, 2535, 2537, 2546, 2696, 2697, 2705, 2708, 2713, 2730, 2746, 2754, 2767, 2768, 2773, 2822, 2855, 2856, 2908, 2911, 2918, 2966, 2978, 3011, 3018, 3036, 3038, 3102, 3113, 3197, 3205, 3206, 3269, 3272, 3418, 3435, 3456, 3468, 3547, 3555, 3576, 3594, 3605, 3609, or 3641.

In some embodiments, the composition comprises an oligonucleotide that inhibits the expression of ANGPTL4, wherein the oligonucleotide comprises an siRNA comprising a sense strand and an antisense strand, wherein the sense strand comprises the nucleoside sequence of any one of SEQ ID NOs: 36, 56, 272, 280, 289, 293, 328, 330, 331, 332, 333, 334, 337, 342, 347, 349, 435, 520, 842, 843, 876, 1001, 1002, 1157, 1164, or 1343; and/or the antisense strand comprises the nucleoside sequence of any one of SEQ ID NOs: 1890, 1910, 2126, 2134, 2143, 2147, 2182, 2184, 2185, 2186, 2187, 2188, 2191, 2196, 2201, 2203, 2289, 2374, 2696, 2697, 2730, 2855, 2856, 3011, 3018, or 3197.

In some embodiments, the siRNA comprises the sense strand and/or the antisense strand sequence of an siRNA of subset A, or a nucleic acid sequence thereof having 3 or 4 nucleoside substitutions, additions, or deletions. In some embodiments, the siRNA comprises the sense strand and/or the antisense strand sequence of an siRNA of subset A, or a nucleic acid sequence thereof having 1 or 2 nucleoside substitutions, additions, or deletions. In some embodiments, the siRNA comprises the sense strand and/or the antisense strand sequence of an siRNA of subset A. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA in Table 4, or a nucleic acid sequence thereof having 3 or 4 nucleoside substitutions, additions, or deletions. In some embodiments, the siRNA comprises the sense strand and/or the antisense strand sequence of an siRNA in Table 4, or a nucleic acid sequence thereof having 1 or 2 nucleoside substitutions, additions, or deletions. In some embodiments, the siRNA comprises the sense strand and/or the antisense strand sequence of an siRNA in Table 4. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset B, or a nucleic acid sequence thereof having 3 or 4 nucleoside substitutions, additions, or deletions. In some embodiments, the siRNA comprises the sense strand and/or the antisense strand sequence of an siRNA of subset B, or a nucleic acid sequence thereof having 1 or 2 nucleoside substitutions, additions, or deletions. In some embodiments, the siRNA comprises the sense strand and/or the antisense strand sequence of an siRNA of subset B. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset C, or a nucleic acid sequence thereof having 3 or 4 nucleoside substitutions, additions, or deletions. In some embodiments, the siRNA comprises the sense strand and/or the antisense strand sequence of an siRNA of subset C, or a nucleic acid sequence thereof having 1 or 2 nucleoside substitutions, additions, or deletions. In some embodiments, the siRNA comprises the sense strand and/or the antisense strand sequence of an siRNA of subset C. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset D, or a nucleic acid sequence thereof having 3 or 4 nucleoside substitutions, additions, or deletions. In some embodiments, the siRNA comprises the sense strand and/or the antisense strand sequence of an siRNA of subset D, or a nucleic acid sequence thereof having 1 or 2 nucleoside substitutions, additions, or deletions. In some embodiments, the siRNA comprises the sense strand and/or the antisense strand sequence of an siRNA of subset D. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset E, or a nucleic acid sequence thereof having 3 or 4 nucleoside substitutions, additions, or deletions. In some embodiments, the siRNA comprises the sense strand and/or the antisense strand sequence of an siRNA of subset E, or a nucleic acid sequence thereof having 1 or 2 nucleoside substitutions, additions, or deletions. In some embodiments, the siRNA comprises the sense strand and/or the antisense strand sequence of an siRNA of subset E. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset F, or a nucleic acid sequence thereof having 3 or 4 nucleoside substitutions, additions, or deletions. In some embodiments, the siRNA comprises the sense strand and/or the antisense strand sequence of an siRNA of subset F, or a nucleic acid sequence thereof having 1 or 2 nucleoside substitutions, additions, or deletions. In some embodiments, the siRNA comprises the sense strand and/or the antisense strand sequence of an siRNA of subset F. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA of subset G, or a nucleic acid sequence thereof having 3 or 4 nucleoside substitutions, additions, or deletions. In some embodiments, the siRNA comprises the sense strand and/or the antisense strand sequence of an siRNA of subset G, or a nucleic acid sequence thereof having 1 or 2 nucleoside substitutions, additions, or deletions. In some embodiments, the siRNA comprises the sense strand and/or the antisense strand sequence of an siRNA of subset G. In some embodiments, the siRNA is cross-reactive with a non-human primate (NHP) ANGPTL4 mRNA. The siRNA may include one or more internucleoside linkages and/or one or more nucleoside modifications.

In some embodiments, the siRNA comprises the sense strand and/or the antisense strand sequence of an siRNA in Table 5, or a nucleic acid sequence thereof having 3 or 4 nucleoside substitutions, additions, or deletions. In some embodiments, the siRNA comprises the sense strand and/or the antisense strand sequence of an siRNA in Table 5, or a nucleic acid sequence thereof having 1 or 2 nucleoside substitutions, additions, or deletions. In some embodiments, the siRNA comprises the sense strand and/or the antisense strand sequence of an siRNA in Table 5. In some embodiments, the siRNA comprises one or more of the internucleoside linkages and/or nucleoside modifications of the siRNA in Table 5. In some embodiments, the siRNA comprises the internucleoside linkages and/or nucleoside modifications of the siRNA in Table 5. In some embodiments, the siRNA is unmodified. In some embodiments, the sense strand sequence of an siRNA in Table 5 comprises modification pattern 1S. In some embodiments, the sense strand sequence of an siRNA in Table 5 comprises modification pattern 3S or 6S. In some embodiments, the sense strand sequence of an siRNA in Table 5 comprises modification pattern 1AS. In some embodiments, the sense strand sequence of an siRNA in Table 5 comprises modification pattern 4AS, 5AS, 7AS, or 8AS.

In some embodiments, the siRNA reduces an ANGPTL mRNA measurement by 10% or more, 20% or more, 30% or more, 40% or more, 50% or more, 60% or more, 70% or more, 80% or more, or 90% or more, relative to a control. In some embodiments, the siRNA reduces an ANGPTL mRNA measurement by 10% or less, 20% or less, 30% or less, 40% or less, 50% or less, 60% or less, 70% or less, 80% or less, or 90% or less, relative to a control. In some embodiments, the reduction is in a cell line such as U-138 MG cells. In some embodiments, the reduction is in response to 1 nM of the siRNA. In some embodiments, the reduction is in response to 10 nM of the siRNA.

Some siRNAs in Table 5 reduced an ANGPTL mRNA measurement by 10% or more, relative to a control. In some embodiments, the siRNA comprises the sense strand and/or the antisense strand sequence of ETD00646, ETD00648, ETD00649, ETD00651, ETD00653, ETD00654, ETD00655, ETD00656, ETD00658, ETD00660, ETD00661, ETD00662, ETD00667, ETD00669, ETD00683, ETD00684, ETD00686, ETD00688, ETD00689, ETD00691, ETD00692, ETD00694, ETD00702, ETD00709, ETD00713, ETD00714, ETD00715, ETD00716, ETD00717, ETD00719, ETD00721, ETD00726, ETD00727, ETD00728, ETD00729, ETD00730, ETD00731, ETD00733, ETD00736, ETD00738, or ETD00743, or a nucleic acid sequence thereof having 3 or 4 nucleoside substitutions, additions, or deletions. In some embodiments, the siRNA comprises the sense strand and/or the antisense strand sequence of ETD00646, ETD00648, ETD00649, ETD00651, ETD00653, ETD00654, ETD00655, ETD00656, ETD00658, ETD00660, ETD00661, ETD00662, ETD00667, ETD00669, ETD00683, ETD00684, ETD00686, ETD00688, ETD00689, ETD00691, ETD00692, ETD00694, ETD00702, ETD00709, ETD00713, ETD00714, ETD00715, ETD00716, ETD00717, ETD00719, ETD00721, ETD00726, ETD00727, ETD00728, ETD00729, ETD00730, ETD00731, ETD00733, ETD00736, ETD00738, or ETD00743, or a nucleic acid sequence thereof having 1 or 2 nucleoside substitutions, additions, or deletions. In some embodiments, the siRNA comprises the sense strand and/or the antisense strand sequence of ETD00646, ETD00648, ETD00649, ETD00651, ETD00653, ETD00654, ETD00655, ETD00656, ETD00658, ETD00660, ETD00661, ETD00662, ETD00667, ETD00669, ETD00683, ETD00684, ETD00686, ETD00688, ETD00689, ETD00691, ETD00692, ETD00694, ETD00702, ETD00709, ETD00713, ETD00714, ETD00715, ETD00716, ETD00717, ETD00719, ETD00721, ETD00726, ETD00727, ETD00728, ETD00729, ETD00730, ETD00731, ETD00733, ETD00736, ETD00738, or ETD00743. In some embodiments, the siRNA comprises one or more of the internucleoside linkages and/or nucleoside modifications of ETD00646, ETD00648, ETD00649, ETD00651, ETD00653, ETD00654, ETD00655, ETD00656, ETD00658, ETD00660, ETD00661, ETD00662, ETD00667, ETD00669, ETD00683, ETD00684, ETD00686, ETD00688, ETD00689, ETD00691, ETD00692, ETD00694, ETD00702, ETD00709, ETD00713, ETD00714, ETD00715, ETD00716, ETD00717, ETD00719, ETD00721, ETD00726, ETD00727, ETD00728, ETD00729, ETD00730, ETD00731, ETD00733, ETD00736, ETD00738, or ETD00743. In some embodiments, the siRNA comprises the internucleoside linkages and/or nucleoside modifications of ETD00646, ETD00648, ETD00649, ETD00651, ETD00653, ETD00654, ETD00655, ETD00656, ETD00658, ETD00660, ETD00661, ETD00662, ETD00667, ETD00669, ETD00683, ETD00684, ETD00686, ETD00688, ETD00689, ETD00691, ETD00692, ETD00694, ETD00702, ETD00709, ETD00713, ETD00714, ETD00715, ETD00716, ETD00717, ETD00719, ETD00721, ETD00726, ETD00727, ETD00728, ETD00729, ETD00730, ETD00731, ETD00733, ETD00736, ETD00738, or ETD00743. In some embodiments, the siRNA is unmodified.

The siRNA may comprise an unmodified version of a sense strand sequence of an siRNA listed in Table 5. In some embodiments, the siRNA of listed in Table 5 comprises any sense strand sequence of a subset A siRNA that is cross-reactive with a NHP ANGPTL4 mRNA. The siRNA may comprise an unmodified version of an antisense strand sequence of an siRNA listed in Table 5. In some embodiments, the siRNA of listed in Table 5 comprises any antisense strand sequence of a subset A siRNA that is cross-reactive with a NHP ANGPTL4 mRNA.

In some embodiments, the siRNA comprises the sense strand and/or the antisense strand sequence of an siRNA in Table 6, or a nucleic acid sequence thereof having 3 or 4 nucleoside substitutions, additions, or deletions. In some embodiments, the siRNA comprises the sense strand and/or the antisense strand sequence of an siRNA in Table 6, or a nucleic acid sequence thereof having 1 or 2 nucleoside substitutions, additions, or deletions. In some embodiments, the siRNA comprises the sense strand and/or the antisense strand sequence of an siRNA in Table 6. In some embodiments, the siRNA comprises one or more of the internucleoside linkages and/or nucleoside modifications of the siRNA in Table 6. In some embodiments, the siRNA comprises the internucleoside linkages and/or nucleoside modifications of the siRNA in Table 6. In some embodiments, the siRNA is unmodified.

The siRNA may comprise an unmodified version of an antisense strand sequence of an siRNA listed in Table 6. In some embodiments, the siRNA comprises the sense strand sequence of SEQ ID NO: 32, 570, 571, 572, 589, 607, 759, 801, 1276, 1285, 1489, 1490, 1564, 1580, 1581, 1589, 1597, 1702, 1840, or 1842, or a nucleic acid sequence thereof having 3 or 4 nucleoside substitutions, additions, or deletions. In some embodiments, the siRNA comprises the sense strand sequence of SEQ ID NO: 32, 570, 571, 572, 589, 607, 759, 801, 1276, 1285, 1489, 1490, 1564, 1580, 1581, 1589, 1597, 1702, 1840, or 1842, or a nucleic acid sequence thereof having 1 or 2 nucleoside substitutions, additions, or deletions. In some embodiments, the siRNA comprises the sense strand sequence of SEQ ID NO: 32, 570, 571, 572, 589, 607, 759, 801, 1276, 1285, 1489, 1490, 1564, 1580, 1581, 1589, 1597, 1702, 1840, or 1842. The siRNA may include the sense strand sequence of SEQ ID NO: 32, 570, 571, 572, 589, 607, 759, 801, 1276, 1285, 1489, 1490, 1564, 1580, 1581, 1589, 1597, 1702, 1840, or 1842, and one or more internucleoside linkages and/or one or more nucleoside modifications. The siRNA may include the sense strand sequence of SEQ ID NO: 32, 570, 571, 572, 589, 607, 759, 801, 1276, 1285, 1489, 1490, 1564, 1580, 1581, 1589, 1597, 1702, 1840, or 1842, and a modification pattern described herein. For example, any of the sense strands comprising the sequence of SEQ ID NO: 32, 570, 571, 572, 589, 607, 759, 801, 1276, 1285, 1489, 1490, 1564, 1580, 1581, 1589, 1597, 1702, 1840, or 1842 may in some cases comprise modification pattern 1S, 2S, 3S, or 6S.

The siRNA may comprise an unmodified version of an antisense strand sequence of an siRNA listed in Table 6. In some embodiments, the siRNA comprises the antisense strand sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696, or a nucleic acid sequence thereof having 3 or 4 nucleoside substitutions, additions, or deletions. In some embodiments, the siRNA comprises the antisense strand sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696, or a nucleic acid sequence thereof having 1 or 2 nucleoside substitutions, additions, or deletions. In some embodiments, the siRNA comprises the antisense strand sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696. The siRNA may include the antisense strand sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696, and one or more internucleoside linkages and/or one or more nucleoside modifications. The siRNA may include the antisense strand sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696, and a modification pattern described herein. For example, any of the antisense strands comprising the sequence of SEQ ID NO: 1886, 2424, 2425, 2426, 2443, 2461, 2613, 2655, 3130, 3139, 3343, 3344, 3418, 3434, 3435, 3443, 3451, 3556, 3694, or 3696 may comprise modification pattern 1AS, 3AS, 4AS, 5AS, 7AS, or 8AS.

Some siRNAs in Table 6 reduced an ANGPTL mRNA measurement by 10% or more, relative to a control. In some embodiments, the siRNA comprises the sense strand and/or the antisense strand sequence of ETD00915, ETD00916, ETD00917, ETD00921, ETD00924, ETD00925, ETD00926, ETD00927, ETD00928, ETD00929, ETD00930, ETD00931, ETD00932, ETD00933, or ETD00934, or a nucleic acid sequence thereof having 3 or 4 nucleoside substitutions, additions, or deletions. In some embodiments, the siRNA comprises the sense strand and/or the antisense strand sequence of ETD00915, ETD00916, ETD00917, ETD00921, ETD00924, ETD00925, ETD00926, ETD00927, ETD00928, ETD00929, ETD00930, ETD00931, ETD00932, ETD00933, or ETD00934, or a nucleic acid sequence thereof having 1 or 2 nucleoside substitutions, additions, or deletions. In some embodiments, the siRNA comprises the sense strand and/or the antisense strand sequence of ETD00915, ETD00916, ETD00917, ETD00921, ETD00924, ETD00925, ETD00926, ETD00927, ETD00928, ETD00929, ETD00930, ETD00931, ETD00932, ETD00933, or ETD00934. In some embodiments, the siRNA comprises one or more of the internucleoside linkages and/or nucleoside modifications of ETD00915, ETD00916, ETD00917, ETD00921, ETD00924, ETD00925, ETD00926, ETD00927, ETD00928, ETD00929, ETD00930, ETD00931, ETD00932, ETD00933, or ETD00934. In some embodiments, the siRNA comprises the internucleoside linkages and/or nucleoside modifications of ETD00915, ETD00916, ETD00917, ETD00921, ETD00924, ETD00925, ETD00926, ETD00927, ETD00928, ETD00929, ETD00930, ETD00931, ETD00932, ETD00933, or ETD00934. In some embodiments, the siRNA is unmodified.

The siRNA may comprise a sense strand sequence of an siRNA that reduced an ANGPTL mRNA measurement by 10% or more, relative to a control, in Table 5 or Table 6. In some embodiments, the siRNA comprises the sense strand sequence of any one of SEQ ID NOS: 14012, 14014, 14015, 14017, 14019, 14020, 14021, 14022, 14024, 14026, 14027, 14028, 14033, 14035, 14049, 14050, 14052, 14054, 14055, 14057, 14058, 14060, 14068, 14075, 14079, 14080, 14081, 14082, 14083, 14085, 14087, 14092, 14093, 14094, 14095, 14096, 14097, 14099, 14102, 14104, 14109, 14114, 14115, 14116, 14120, 14123, 14124, 14125, 14126, 14127, 14128, 14129, 14130, 14131, 14132, or 14133, or a nucleic acid sequence thereof having 3 or 4 nucleoside substitutions, additions, or deletions. In some embodiments, the siRNA comprises the sense strand sequence of any one of SEQ ID NOS: 14012, 14014, 14015, 14017, 14019, 14020, 14021, 14022, 14024, 14026, 14027, 14028, 14033, 14035, 14049, 14050, 14052, 14054, 14055, 14057, 14058, 14060, 14068, 14075, 14079, 14080, 14081, 14082, 14083, 14085, 14087, 14092, 14093, 14094, 14095, 14096, 14097, 14099, 14102, 14104, 14109, 14114, 14115, 14116, 14120, 14123, 14124, 14125, 14126, 14127, 14128, 14129, 14130, 14131, 14132, or 14133, ora nucleic acid sequence thereof having 1 or 2 nucleoside substitutions, additions, or deletions. In some embodiments, the siRNA comprises the sense strand sequence of any one of SEQ ID NOS: 14012, 14014, 14015, 14017, 14019, 14020, 14021, 14022, 14024, 14026, 14027, 14028, 14033, 14035, 14049, 14050, 14052, 14054, 14055, 14057, 14058, 14060, 14068, 14075, 14079, 14080, 14081, 14082, 14083, 14085, 14087, 14092, 14093, 14094, 14095, 14096, 14097, 14099, 14102, 14104, 14109, 14114, 14115, 14116, 14120, 14123, 14124, 14125, 14126, 14127, 14128, 14129, 14130, 14131, 14132, or 14133. In some embodiments, the siRNA comprises one or more of the internucleoside linkages and/or nucleoside modifications of the sense strand of 14012, 14014, 14015, 14017, 14019, 14020, 14021, 14022, 14024, 14026, 14027, 14028, 14033, 14035, 14049, 14050, 14052, 14054, 14055, 14057, 14058, 14060, 14068, 14075, 14079, 14080, 14081, 14082, 14083, 14085, 14087, 14092, 14093, 14094, 14095, 14096, 14097, 14099, 14102, 14104, 14109, 14114, 14115, 14116, 14120, 14123, 14124, 14125, 14126, 14127, 14128, 14129, 14130, 14131, 14132, or 14133. In some embodiments, the siRNA comprises the internucleoside linkages and/or nucleoside modifications of the sense strand of 14012, 14014, 14015, 14017, 14019, 14020, 14021, 14022, 14024, 14026, 14027, 14028, 14033, 14035, 14049, 14050, 14052, 14054, 14055, 14057, 14058, 14060, 14068, 14075, 14079, 14080, 14081, 14082, 14083, 14085, 14087, 14092, 14093, 14094, 14095, 14096, 14097, 14099, 14102, 14104, 14109, 14114, 14115, 14116, 14120, 14123, 14124, 14125, 14126, 14127, 14128, 14129, 14130, 14131, 14132, or 14133. In some embodiments, the siRNA is unmodified.

The siRNA may comprise an antisense strand sequence of an siRNA that reduced an ANGPTL mRNA measurement by 10% or more, relative to a control, in Table 5 or Table 6. In some embodiments, the siRNA comprises the antisense strand sequence of any one of SEQ ID NOS: 14167, 14169, 14170, 14172, 14174, 14175, 14176, 14177, 14179, 14181, 14182, 14183, 14188, 14190, 14204, 14205, 14207, 14209, 14210, 14212, 14213, 14215, 14223, 14230, 14234, 14235, 14236, 14237, 14238, 14240, 14242, 14247, 14248, 14249, 14250, 14251, 14252, 14254, 14257, 14259, 14264, 14269, 14270, 14271, 14275, 14278, 14279, 14280, 14281, 14282, 14283, 14284, 14285, 14286, 14287, or 14288, or a nucleic acid sequence thereof having 3 or 4 nucleoside substitutions, additions, or deletions. In some embodiments, the siRNA comprises the antisense strand sequence of any one of SEQ ID NOS: 14167, 14169, 14170, 14172, 14174, 14175, 14176, 14177, 14179, 14181, 14182, 14183, 14188, 14190, 14204, 14205, 14207, 14209, 14210, 14212, 14213, 14215, 14223, 14230, 14234, 14235, 14236, 14237, 14238, 14240, 14242, 14247, 14248, 14249, 14250, 14251, 14252, 14254, 14257, 14259, 14264, 14269, 14270, 14271, 14275, 14278, 14279, 14280, 14281, 14282, 14283, 14284, 14285, 14286, 14287, or 14288, or a nucleic acid sequence thereof having 1 or 2 nucleoside substitutions, additions, or deletions. In some embodiments, the siRNA comprises the antisense strand sequence of any one of SEQ ID NOS: 14167, 14169, 14170, 14172, 14174, 14175, 14176, 14177, 14179, 14181, 14182, 14183, 14188, 14190, 14204, 14205, 14207, 14209, 14210, 14212, 14213, 14215, 14223, 14230, 14234, 14235, 14236, 14237, 14238, 14240, 14242, 14247, 14248, 14249, 14250, 14251, 14252, 14254, 14257, 14259, 14264, 14269, 14270, 14271, 14275, 14278, 14279, 14280, 14281, 14282, 14283, 14284, 14285, 14286, 14287, or 14288. In some embodiments, the siRNA comprises one or more of the internucleoside linkages and/or nucleoside modifications of the antisense strand of 14167, 14169, 14170, 14172, 14174, 14175, 14176, 14177, 14179, 14181, 14182, 14183, 14188, 14190, 14204, 14205, 14207, 14209, 14210, 14212, 14213, 14215, 14223, 14230, 14234, 14235, 14236, 14237, 14238, 14240, 14242, 14247, 14248, 14249, 14250, 14251, 14252, 14254, 14257, 14259, 14264, 14269, 14270, 14271, 14275, 14278, 14279, 14280, 14281, 14282, 14283, 14284, 14285, 14286, 14287, or 14288. In some embodiments, the siRNA comprises the internucleoside linkages and/or nucleoside modifications of the antisense strand of 14167, 14169, 14170, 14172, 14174, 14175, 14176, 14177, 14179, 14181, 14182, 14183, 14188, 14190, 14204, 14205, 14207, 14209, 14210, 14212, 14213, 14215, 14223, 14230, 14234, 14235, 14236, 14237, 14238, 14240, 14242, 14247, 14248, 14249, 14250, 14251, 14252, 14254, 14257, 14259, 14264, 14269, 14270, 14271, 14275, 14278, 14279, 14280, 14281, 14282, 14283, 14284, 14285, 14286, 14287, or 14288. In some embodiments, the siRNA is unmodified.

The siRNA may comprise an unmodified version of a sense strand sequence of an siRNA that reduced an ANGPTL mRNA measurement by 10% or more, relative to a control, in Table 5 or Table 6. In some embodiments, the siRNA comprises the sense strand sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, or a nucleic acid sequence thereof having 3 or 4 nucleoside substitutions, additions, or deletions. In some embodiments, the siRNA comprises the sense strand sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, or a nucleic acid sequence thereof having 1 or 2 nucleoside substitutions, additions, or deletions. In some embodiments, the siRNA comprises the sense strand sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842. The siRNA may include the sense strand sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, and one or more internucleoside linkages and/or one or more nucleoside modifications. The siRNA may include the sense strand sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, and a modification pattern described herein (e.g. modification pattern 1S, 2S, 3S, 4S, 5S, or 6S).

The siRNA may comprise an unmodified version of an antisense strand sequence of an siRNA that reduced an ANGPTL mRNA measurement by 10% or more, relative to a control, in Table 5 or Table 6. In some embodiments, the siRNA comprises the antisense strand sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or a nucleic acid sequence thereof having 3 or 4 nucleoside substitutions, additions, or deletions. In some embodiments, the siRNA comprises the antisense strand sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or a nucleic acid sequence thereof having 1 or 2 nucleoside substitutions, additions, or deletions. In some embodiments, the siRNA comprises the antisense strand sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696. The siRNA may include the antisense strand sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, and one or more internucleoside linkages and/or one or more nucleoside modifications. The siRNA may include the antisense strand sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, and a modification pattern described herein (e.g. modification pattern 1AS, 2AS, 3AS, 4AS, 5AS, 6AS, 7AS, 8AS, or 9AS).

In some embodiments, the siRNA comprises the sense strand and/or the antisense strand sequence of an siRNA in Table 7, or a nucleic acid sequence thereof having 3 or 4 nucleoside substitutions, additions, or deletions. In some embodiments, the siRNA comprises the sense strand and/or the antisense strand sequence of an siRNA in Table 7, or a nucleic acid sequence thereof having 1 or 2 nucleoside substitutions, additions, or deletions. In some embodiments, the siRNA comprises the sense strand and/or the antisense strand sequence of an siRNA in Table 7. In some embodiments, the siRNA comprises one or more of the internucleoside linkages and/or nucleoside modifications of the siRNA in Table 7. In some embodiments, the siRNA comprises the internucleoside linkages and/or nucleoside modifications of the siRNA in Table 7. In some embodiments, the siRNA is unmodified.

In some embodiments, the siRNA comprises the sense strand and/or the antisense strand sequence of an siRNA in Table 8, or a nucleic acid sequence thereof having 3 or 4 nucleoside substitutions, additions, or deletions. In some embodiments, the siRNA comprises the sense strand and/or the antisense strand sequence of an siRNA in Table 8, or a nucleic acid sequence thereof having 1 or 2 nucleoside substitutions, additions, or deletions. In some embodiments, the siRNA comprises the sense strand and/or the antisense strand sequence of an siRNA in Table 8. In some embodiments, the siRNA comprises one or more of the internucleoside linkages and/or nucleoside modifications of the siRNA in Table 8. In some embodiments, the siRNA comprises the internucleoside linkages and/or nucleoside modifications of the siRNA in Table 8. In some embodiments, the siRNA is unmodified.

In some embodiments, the siRNA comprises the sense strand and/or the antisense strand sequence of an siRNA in Table 10, or a nucleic acid sequence thereof having 3 or 4 nucleoside substitutions, additions, or deletions. In some embodiments, the siRNA comprises the sense strand and/or the antisense strand sequence of an siRNA in Table 10, or a nucleic acid sequence thereof having 1 or 2 nucleoside substitutions, additions, or deletions. In some embodiments, the siRNA comprises the sense strand and/or the antisense strand sequence of an siRNA in Table 10. In some embodiments, the siRNA comprises one or more of the internucleoside linkages and/or nucleoside modifications of the siRNA in Table 10. In some embodiments, the siRNA comprises the internucleoside linkages and/or nucleoside modifications of the siRNA in Table 10. In some embodiments, the siRNA is unmodified.

In some embodiments, the siRNA comprises the sense strand and/or the antisense strand sequence of an siRNA in Table 15, or a nucleic acid sequence thereof having 3 or 4 nucleoside substitutions, additions, or deletions. In some embodiments, the siRNA comprises the sense strand and/or the antisense strand sequence of an siRNA in Table 15, or a nucleic acid sequence thereof having 1 or 2 nucleoside substitutions, additions, or deletions. In some embodiments, the siRNA comprises the sense strand and/or the antisense strand sequence of an siRNA in Table 15. In some embodiments, the siRNA comprises one or more of the internucleoside linkages and/or nucleoside modifications of the siRNA in Table 15. In some embodiments, the siRNA comprises the internucleoside linkages and/or nucleoside modifications of the siRNA in Table 15. In some embodiments, the siRNA is unmodified.

In some embodiments, the siRNA comprises the sense strand and/or the antisense strand sequence of an siRNA in Table 16, or a nucleic acid sequence thereof having 3 or 4 nucleoside substitutions, additions, or deletions. In some embodiments, the siRNA comprises the sense strand and/or the antisense strand sequence of an siRNA in Table 16, or a nucleic acid sequence thereof having 1 or 2 nucleoside substitutions, additions, or deletions. In some embodiments, the siRNA comprises the sense strand and/or the antisense strand sequence of an siRNA in Table 16. In some embodiments, the siRNA comprises one or more of the internucleoside linkages and/or nucleoside modifications of the siRNA in Table 16. In some embodiments, the siRNA comprises the internucleoside linkages and/or nucleoside modifications of the siRNA in Table 16. In some embodiments, the siRNA is unmodified.

In some embodiments, the sense strand comprises a nucleoside sequence at least 85% identical to any one of SEQ ID NOS: 13970-13973. In some embodiments, the sense strand comprises the nucleoside sequence of any one of SEQ ID NOS: 13970-13973, or a sense strand sequence thereof having 1 or 2 nucleoside substitutions, additions, or deletions. In some embodiments, the sense strand comprises the nucleoside sequence of any one of SEQ ID NOS: 13970-13973. The siRNA may include the sense strand sequence of any one of SEQ ID NOS: 13970-13973, and one or more internucleoside linkages and/or one or more nucleoside modifications. The siRNA may include the sense strand sequence of any one of SEQ ID NOS: 13970-13973, and a modification pattern described herein (e.g. modification pattern 1S, 2S, 3S, 4S, 5S, or 6S). The sense strand may include an overhang (e.g. a 2 nucleotide overhang such as 2 uracil nucleotides).

In some embodiments, the antisense strand comprises a nucleoside sequence at least 85% identical to any one of SEQ ID NOS: 13978-13981. In some embodiments, the antisense strand comprises the nucleoside sequence of any one of SEQ ID NOS: 13978-13981, or an antisense strand sequence thereof having 1 or 2 nucleoside substitutions, additions, or deletions. In some embodiments, the antisense strand comprises the nucleoside sequence of any one of SEQ ID NOS: 13978-13981. The siRNA may include the sense strand sequence of any one of SEQ ID NOS: 13978-13981, and one or more internucleoside linkages and/or one or more nucleoside modifications. The siRNA may include the sense strand sequence of any one of SEQ ID NOS: 13978-13981, and a modification pattern described herein (e.g. modification pattern 1AS, 2AS, 3AS, 4AS, 5AS, 6AS, 7AS, 8AS, or 9AS). The antisense strand may include an overhang (e.g. a 2 nucleotide overhang such as 2 uracil nucleotides).

In some embodiments, the sense strand comprises a nucleoside sequence at least 85% identical to any one of SEQ ID NOS: 13974-13977. In some embodiments, the sense strand comprises the nucleoside sequence of any one of SEQ ID NOS: 13974-13977, or a sense strand sequence thereof having 1 or 2 nucleoside substitutions, additions, or deletions. In some embodiments, the sense strand comprises the nucleoside sequence of any one of SEQ ID NOS: 13974-13977. The siRNA may include the sense strand sequence of any one of SEQ ID NOS: 13974-13977, and one or more internucleoside linkages and/or one or more nucleoside modifications. The siRNA may include the sense strand sequence of any one of SEQ ID NOS: 13974-13977, and a modification pattern described herein (e.g. modification pattern 1S, 2S, 3S, 4S, 5S, or 6S). The sense strand may include an overhang.

In some embodiments, the antisense strand comprises a nucleoside sequence at least 85% identical to any one of SEQ ID NOS: 13982-13985. In some embodiments, the antisense strand comprises the nucleoside sequence of any one of SEQ ID NOS: 13982-13985, or an antisense strand sequence thereof having 1 or 2 nucleoside substitutions, additions, or deletions. In some embodiments, the antisense strand comprises the nucleoside sequence of any one of SEQ ID NOS: 13982-13985. The siRNA may include the sense strand sequence of any one of SEQ ID NOS: 13982-13985, and one or more internucleoside linkages and/or one or more nucleoside modifications. The siRNA may include the sense strand sequence of any one of SEQ ID NOS: 13982-13985, and a modification pattern described herein (e.g. modification pattern 1AS, 2AS, 3AS, 4AS, 5AS, 6AS, 7AS, 8AS, or 9AS). The antisense strand may include an overhang.

In some embodiments, the sense strand and/or antisense strand comprises a nucleoside sequence at least 85% identical to the sense strand and/or antisense strand of any one of EDT01062 to ETD01065, EDT01062.1 to ETD01065.1, EDT01062.2 to ETD01065.2, EDT01062.3 to ETD01065.3, EDT01062.4 to ETD01065.4, EDT01062.5 to ETD01065.5, EDT01062.6 to ETD01065.6, EDT01062.7 to ETD01065.7, or EDT01062.8 to ETD01065.8. In some embodiments, the sense strand and/or antisense strand comprises the sense strand and/or antisense strand of any one of EDT01062 to ETD01065, EDT01062.1 to ETD01065.1, EDT01062.2 to ETD01065.2, EDT01062.3 to ETD01065.3, EDT01062.4 to ETD01065.4, EDT01062.5 to ETD01065.5, EDT01062.6 to ETD01065.6, EDT01062.7 to ETD01065.7, or EDT01062.8 to ETD01065.8, or a sense strand and/or antisense strand sequence thereof having 1 or 2 nucleoside substitutions, additions, or deletions. In some embodiments, the sense strand and/or antisense strand comprises the sense strand and/or antisense strand of any one of EDT01062 to ETD01065, EDT01062.1 to ETD01065.1, EDT01062.2 to ETD01065.2, EDT01062.3 to ETD01065.3, EDT01062.4 to ETD01065.4, EDT01062.5 to ETD01065.5, EDT01062.6 to ETD01065.6, EDT01062.7 to ETD01065.7, or EDT01062.8 to ETD01065.8. The sense strand and/or antisense strand may comprise a GalNAc ligand. The sense strand and/or antisense strand may exclude any GalNAc ligand.

The sense strand may comprise the nucleoside sequence of SEQ ID NO: 13973, or a derivative thereof. In some embodiments, the sense strand comprises a nucleoside sequence at least 85% identical to SEQ ID NO: 13973. The sense strand comprising the nucleoside sequence of SEQ ID NO: 13973, or derivative thereof, may include the sense strand comprising a nucleoside sequence at least 85% identical to SEQ ID NO: 13973. In some embodiments, the sense strand comprises the nucleoside sequence of SEQ ID NO: 13973, or a sense strand sequence thereof having 1 or 2 nucleoside substitutions, additions, or deletions. The sense strand comprising the nucleoside sequence of SEQ ID NO: 13973 derivative may include the sense strand comprising a nucleoside sequence having 1 or 2 nucleoside substitutions, additions, or deletions. In some embodiments, the sense strand comprises the nucleoside sequence of SEQ ID NO: 13973. The sense strand sequence may consist of the nucleotide sequence of SEQ ID NO: 13973. The sense strand comprising the nucleoside sequence of SEQ ID NO: 13973, or derivative thereof, may include a GalNAc ligand (e.g. attached to a 3' or 5' end). The sense strand comprising the nucleoside sequence of SEQ ID NO: 13973, or derivative thereof, may include a 2 nucleotide overhang. The sense strand comprising the nucleoside sequence of SEQ ID NO: 13973, or derivative thereof, may include modification pattern 1S. The sense strand comprising the nucleoside sequence of SEQ ID NO: 13973, or derivative thereof, may include modification pattern 2S. The sense strand comprising the nucleoside sequence of SEQ ID NO: 13973, or derivative thereof, may include modification pattern 3S. The sense strand comprising the nucleoside sequence of SEQ ID NO: 13973, or derivative thereof, may include modification pattern 4S. The sense strand comprising the nucleoside sequence of SEQ ID NO: 13973, or derivative thereof, may include modification pattern 5S. The sense strand comprising the nucleoside sequence of SEQ ID NO: 13973, or derivative thereof, may include modification pattern 6S.

The sense strand may comprise the nucleoside sequence of SEQ ID NO: 13977, or a derivative thereof. In some embodiments, the sense strand comprises a nucleoside sequence at least 85% identical to SEQ ID NO: 13977. The sense strand comprising the nucleoside sequence of SEQ ID NO: 13977, or derivative thereof, may include the sense strand comprising a nucleoside sequence at least 85% identical to SEQ ID NO: 13977. In some embodiments, the sense strand comprises the nucleoside sequence of SEQ ID NO: 13977, or a sense strand sequence thereof having 1 or 2 nucleoside substitutions, additions, or deletions. The sense strand comprising the nucleoside sequence of SEQ ID NO: 13977 derivative may include the sense strand comprising a nucleoside sequence having 1 or 2 nucleoside substitutions, additions, or deletions. In some embodiments, the sense strand comprises the nucleoside sequence of SEQ ID NO: 13977. The sense strand sequence may consist of the nucleotide sequence of SEQ ID NO: 13977. The sense strand comprising the nucleoside sequence of SEQ ID NO: 13977, or derivative thereof, may include a GalNAc ligand (e.g. attached to a 3' or 5' end). The sense strand comprising the nucleoside sequence of SEQ ID NO: 13977, or derivative thereof, may include a 2 nucleotide overhang. The sense strand comprising the nucleoside sequence of SEQ ID NO: 13977, or derivative thereof, may include modification pattern 1S. The sense strand comprising the nucleoside sequence of SEQ ID NO: 13977, or derivative thereof, may include modification pattern 2S. The sense strand comprising the nucleoside sequence of SEQ ID NO: 13977, or derivative thereof, may include modification pattern 3S. The sense strand comprising the nucleoside sequence of SEQ ID NO: 13977, or derivative thereof, may include modification pattern 4S. The sense strand comprising the nucleoside sequence of SEQ ID NO: 13977, or derivative thereof, may include modification pattern 5S. The sense strand comprising the nucleoside sequence of SEQ ID NO: 13977, or derivative thereof, may include modification pattern 6S.

The antisense strand may comprise the nucleoside sequence of SEQ ID NO: 13981, or a derivative thereof. In some embodiments, the antisense strand comprises a nucleoside sequence at least 85% identical to SEQ ID NO: 13981. The antisense strand comprising the nucleoside sequence of SEQ ID NO: 13981, or derivative thereof, may include the antisense strand comprising a nucleoside sequence at least 85% identical to SEQ ID NO: 13981. In some embodiments, the antisense strand comprises the nucleoside sequence of SEQ ID NO: 13981, or an antisense strand sequence thereof having 1 or 2 nucleoside substitutions, additions, or deletions. The antisense strand comprising the nucleoside sequence of SEQ ID NO: 13981 derivative may include the antisense strand comprising a nucleoside sequence having 1 or 2 nucleoside substitutions, additions, or deletions. In some embodiments, the antisense strand comprises the nucleoside sequence of SEQ ID NO: 13981. The antisense strand sequence may consist of the nucleotide sequence of SEQ ID NO: 13981. The antisense strand comprising the nucleoside sequence of SEQ ID NO: 13981, or derivative thereof, may include a GalNAc ligand (e.g. attached to a 3' or 5' end). The antisense strand comprising the nucleoside sequence of SEQ ID NO: 13981, or derivative thereof, may include a 2 nucleotide overhang. The antisense strand comprising the nucleoside sequence of SEQ ID NO: 13981, or derivative thereof, may include modification pattern 1AS. The antisense strand comprising the nucleoside sequence of SEQ ID NO: 13981, or derivative thereof, may include modification pattern 2AS. The antisense strand comprising the nucleoside sequence of SEQ ID NO: 13981, or derivative thereof, may include modification pattern 3AS. The antisense strand comprising the nucleoside sequence of SEQ ID NO: 13981, or derivative thereof, may include modification pattern 4AS. The antisense strand comprising the nucleoside sequence of SEQ ID NO: 13981, or derivative thereof, may include modification pattern 5AS. The antisense strand comprising the nucleoside sequence of SEQ ID NO: 13981, or derivative thereof, may include modification pattern 6AS. The antisense strand comprising the nucleoside sequence of SEQ ID NO: 13981, or derivative thereof, may include modification pattern 7AS. The antisense strand comprising the nucleoside sequence of SEQ ID NO: 13981, or derivative thereof, may include modification pattern 8AS. The antisense strand comprising the nucleoside sequence of SEQ ID NO: 13981, or derivative thereof, may include modification pattern 9AS.

The antisense strand may comprise the nucleoside sequence of SEQ ID NO: 13985, or a derivative thereof. In some embodiments, the antisense strand comprises a nucleoside sequence at least 85% identical to SEQ ID NO: 13985. The antisense strand comprising the nucleoside sequence of SEQ ID NO: 13985, or derivative thereof, may include the antisense strand comprising a nucleoside sequence at least 85% identical to SEQ ID NO: 13985. In some embodiments, the antisense strand comprises the nucleoside sequence of SEQ ID NO: 13985, or an antisense strand sequence thereof having 1 or 2 nucleoside substitutions, additions, or deletions. The antisense strand comprising the nucleoside sequence of SEQ ID NO: 13985 derivative may include the antisense strand comprising a nucleoside sequence having 1 or 2 nucleoside substitutions, additions, or deletions. In some embodiments, the antisense strand comprises the nucleoside sequence of SEQ ID NO: 13985. The antisense strand sequence may consist of the nucleotide sequence of SEQ ID NO: 13985. The antisense strand comprising the nucleoside sequence of SEQ ID NO: 13985, or derivative thereof, may include a GalNAc ligand (e.g. attached to a 3' or 5' end). The antisense strand comprising the nucleoside sequence of SEQ ID NO: 13985, or derivative thereof, may include a 2 nucleotide overhang. The antisense strand comprising the nucleoside sequence of SEQ ID NO: 13985, or derivative thereof, may include modification pattern 1AS. The antisense strand comprising the nucleoside sequence of SEQ ID NO: 13985, or derivative thereof, may include modification pattern 2AS. The antisense strand comprising the nucleoside sequence of SEQ ID NO: 13985, or derivative thereof, may include modification pattern 3AS. The antisense strand comprising the nucleoside sequence of SEQ ID NO: 13985, or derivative thereof, may include modification pattern 4AS. The antisense strand comprising the nucleoside sequence of SEQ ID NO: 13985, or derivative thereof, may include modification pattern 5AS. The antisense strand comprising the nucleoside sequence of SEQ ID NO: 13985, or derivative thereof, may include modification pattern 6AS. The antisense strand comprising the nucleoside sequence of SEQ ID NO: 13985, or derivative thereof, may include modification pattern 7AS. The antisense strand comprising the nucleoside sequence of SEQ ID NO: 13985, or derivative thereof, may include modification pattern 8AS. The antisense strand comprising the nucleoside sequence of SEQ ID NO: 13985, or derivative thereof, may include modification pattern 9AS.

In some embodiments, the sense strand comprises a nucleoside sequence at least 85% identical to any one of SEQ ID NOS: 14006-14011. In some embodiments, the sense strand comprises the nucleoside sequence of any one of SEQ ID NOS: 14006-14011, or a sense strand sequence thereof having 1 or 2 nucleoside substitutions, additions, or deletions. In some embodiments, the sense strand comprises the nucleoside sequence of any one of SEQ ID NOS: 14006-14011. The sense strand may comprise a GalNAc ligand. In some embodiments, the antisense strand comprises a nucleoside sequence at least 85% identical to any one of SEQ ID NOS: 14158-14166. In some embodiments, the antisense strand comprises the nucleoside sequence of any one of SEQ ID NOS: 14158-14166, or an antisense strand sequence thereof having 1 or 2 nucleoside substitutions, additions, or deletions. In some embodiments, the antisense strand comprises the nucleoside sequence of any one of SEQ ID NOS: 14158-14166. The antisense strand may comprise a GalNAc ligand.

In some embodiments, the siRNA a sense strand comprising the sequence of SEQ ID NO: 13970, or a nucleic acid sequence thereof having 3 or 4 nucleoside substitutions, additions, or deletions. In some embodiments, the siRNA a sense strand comprising the sequence of SEQ ID NO: 13970, or a nucleic acid sequence thereof having 1 or 2 nucleoside substitutions, additions, or deletions. In some embodiments, the siRNA a sense strand comprising the sequence of SEQ ID NO: 13970. In some embodiments, the sense strand comprises one or more internucleoside linkages and/or nucleoside modifications. In some embodiments, the siRNA an antisense strand comprising the sequence of SEQ ID NO: 13978, or a nucleic acid sequence thereof having 3 or 4 nucleoside substitutions, additions, or deletions. In some embodiments, the siRNA an antisense strand comprising the sequence of SEQ ID NO: 13978, or a nucleic acid sequence thereof having 1 or 2 nucleoside substitutions, additions, or deletions. In some embodiments, the siRNA an antisense strand comprising the sequence of SEQ ID NO: 13978. In some embodiments, the antisense strand comprises one or more internucleoside linkages and/or nucleoside modifications.

In some embodiments, the siRNA a sense strand comprising the sequence of SEQ ID NO: 13971, or a nucleic acid sequence thereof having 3 or 4 nucleoside substitutions, additions, or deletions. In some embodiments, the siRNA a sense strand comprising the sequence of SEQ ID NO: 13971, or a nucleic acid sequence thereof having 1 or 2 nucleoside substitutions, additions, or deletions. In some embodiments, the siRNA a sense strand comprising the sequence of SEQ ID NO: 13971. In some embodiments, the sense strand comprises one or more internucleoside linkages and/or nucleoside modifications. In some embodiments, the siRNA an antisense strand comprising the sequence of SEQ ID NO: 13979, or a nucleic acid sequence thereof having 3 or 4 nucleoside substitutions, additions, or deletions. In some embodiments, the siRNA an antisense strand comprising the sequence of SEQ ID NO: 13979, or a nucleic acid sequence thereof having 1 or 2 nucleoside substitutions, additions, or deletions. In some embodiments, the siRNA an antisense strand comprising the sequence of SEQ ID NO: 13979. In some embodiments, the antisense strand comprises one or more internucleoside linkages and/or nucleoside modifications.

In some embodiments, the siRNA a sense strand comprising the sequence of SEQ ID NO: 13972, or a nucleic acid sequence thereof having 3 or 4 nucleoside substitutions, additions, or deletions. In some embodiments, the siRNA a sense strand comprising the sequence of SEQ ID NO: 13972, or a nucleic acid sequence thereof having 1 or 2 nucleoside substitutions, additions, or deletions. In some embodiments, the siRNA a sense strand comprising the sequence of SEQ ID NO: 13972. In some embodiments, the sense strand comprises one or more internucleoside linkages and/or nucleoside modifications. In some embodiments, the siRNA an antisense strand comprising the sequence of SEQ ID NO: 13980, or a nucleic acid sequence thereof having 3 or 4 nucleoside substitutions, additions, or deletions. In some embodiments, the siRNA an antisense strand comprising the sequence of SEQ ID NO: 13980, or a nucleic acid sequence thereof having 1 or 2 nucleoside substitutions, additions, or deletions. In some embodiments, the siRNA an antisense strand comprising the sequence of SEQ ID NO: 13980. In some embodiments, the antisense strand comprises one or more internucleoside linkages and/or nucleoside modifications.

In some embodiments, the siRNA a sense strand comprising the sequence of SEQ ID NO: 13973, or a nucleic acid sequence thereof having 3 or 4 nucleoside substitutions, additions, or deletions. In some embodiments, the siRNA a sense strand comprising the sequence of SEQ ID NO: 13973, or a nucleic acid sequence thereof having 1 or 2 nucleoside substitutions, additions, or deletions. In some embodiments, the siRNA a sense strand comprising the sequence of SEQ ID NO: 13973. In some embodiments, the sense strand comprises one or more internucleoside linkages and/or nucleoside modifications. In some embodiments, the siRNA an antisense strand comprising the sequence of SEQ ID NO: 13981, or a nucleic acid sequence thereof having 3 or 4 nucleoside substitutions, additions, or deletions. In some embodiments, the siRNA an antisense strand comprising the sequence of SEQ ID NO: 13981, or a nucleic acid sequence thereof having 1 or 2 nucleoside substitutions, additions, or deletions. In some embodiments, the siRNA an antisense strand comprising the sequence of SEQ ID NO: 13981. In some embodiments, the antisense strand comprises one or more internucleoside linkages and/or nucleoside modifications.

In some embodiments, the siRNA a sense strand comprising the sequence of SEQ ID NO: 1285, or a nucleic acid sequence thereof having 3 or 4 nucleoside substitutions, additions, or deletions. In some embodiments, the siRNA a sense strand comprising the sequence of SEQ ID NO: 1285, or a nucleic acid sequence thereof having 1 or 2 nucleoside substitutions, additions, or deletions. In some embodiments, the siRNA a sense strand comprising the sequence of SEQ ID NO: 1285. In some embodiments, the sense strand comprises one or more internucleoside linkages and/or nucleoside modifications. In some embodiments, the siRNA an antisense strand comprising the sequence of SEQ ID NO: 3139, or a nucleic acid sequence thereof having 3 or 4 nucleoside substitutions, additions, or deletions. In some embodiments, the siRNA an antisense strand comprising the sequence of SEQ ID NO: 3139, or a nucleic acid sequence thereof having 1 or 2 nucleoside substitutions, additions, or deletions. In some embodiments, the siRNA an antisense strand comprising the sequence of SEQ ID NO: 3139. In some embodiments, the antisense strand comprises one or more internucleoside linkages and/or nucleoside modifications.

In some embodiments, the siRNA a sense strand comprising the sequence of SEQ ID NO: 1580, or a nucleic acid sequence thereof having 3 or 4 nucleoside substitutions, additions, or deletions. In some embodiments, the siRNA a sense strand comprising the sequence of SEQ ID NO: 1580, or a nucleic acid sequence thereof having 1 or 2 nucleoside substitutions, additions, or deletions. In some embodiments, the siRNA a sense strand comprising the sequence of SEQ ID NO: 1580. In some embodiments, the sense strand comprises one or more internucleoside linkages and/or nucleoside modifications. In some embodiments, the siRNA an antisense strand comprising the sequence of SEQ ID NO: 3434, or a nucleic acid sequence thereof having 3 or 4 nucleoside substitutions, additions, or deletions. In some embodiments, the siRNA an antisense strand comprising the sequence of SEQ ID NO: 3434, or a nucleic acid sequence thereof having 1 or 2 nucleoside substitutions, additions, or deletions. In some embodiments, the siRNA an antisense strand comprising the sequence of SEQ ID NO: 3434. In some embodiments, the antisense strand comprises one or more internucleoside linkages and/or nucleoside modifications.

In some embodiments, the siRNA a sense strand comprising the sequence of SEQ ID NO: 13974, or a nucleic acid sequence thereof having 3 or 4 nucleoside substitutions, additions, or deletions. In some embodiments, the siRNA a sense strand comprising the sequence of SEQ ID NO: 13974, or a nucleic acid sequence thereof having 1 or 2 nucleoside substitutions, additions, or deletions. In some embodiments, the siRNA a sense strand comprising the sequence of SEQ ID NO: 13974. In some embodiments, the sense strand comprises one or more internucleoside linkages and/or nucleoside modifications. In some embodiments, the siRNA an antisense strand comprising the sequence of SEQ ID NO: 13982, or a nucleic acid sequence thereof having 3 or 4 nucleoside substitutions, additions, or deletions. In some embodiments, the siRNA an antisense strand comprising the sequence of SEQ ID NO: 13982, or a nucleic acid sequence thereof having 1 or 2 nucleoside substitutions, additions, or deletions. In some embodiments, the siRNA an antisense strand comprising the sequence of SEQ ID NO: 13982. In some embodiments, the antisense strand comprises one or more internucleoside linkages and/or nucleoside modifications.

In some embodiments, the siRNA a sense strand comprising the sequence of SEQ ID NO: 13975, or a nucleic acid sequence thereof having 3 or 4 nucleoside substitutions, additions, or deletions. In some embodiments, the siRNA a sense strand comprising the sequence of SEQ ID NO:

13975, or a nucleic acid sequence thereof having 1 or 2 nucleoside substitutions, additions, or deletions. In some embodiments, the siRNA a sense strand comprising the sequence of SEQ ID NO: 13975. In some embodiments, the sense strand comprises one or more internucleoside linkages and/or nucleoside modifications. In some embodiments, the siRNA an antisense strand comprising the sequence of SEQ ID NO: 13983, or a nucleic acid sequence thereof having 3 or 4 nucleoside substitutions, additions, or deletions. In some embodiments, the siRNA an antisense strand comprising the sequence of SEQ ID NO: 13983, or a nucleic acid sequence thereof having 1 or 2 nucleoside substitutions, additions, or deletions. In some embodiments, the siRNA an antisense strand comprising the sequence of SEQ ID NO: 13983. In some embodiments, the antisense strand comprises one or more internucleoside linkages and/or nucleoside modifications.

In some embodiments, the siRNA a sense strand comprising the sequence of SEQ ID NO: 13976, or a nucleic acid sequence thereof having 3 or 4 nucleoside substitutions, additions, or deletions. In some embodiments, the siRNA a sense strand comprising the sequence of SEQ ID NO: 13976, or a nucleic acid sequence thereof having 1 or 2 nucleoside substitutions, additions, or deletions. In some embodiments, the siRNA a sense strand comprising the sequence of SEQ ID NO: 13976. In some embodiments, the sense strand comprises one or more internucleoside linkages and/or nucleoside modifications. In some embodiments, the siRNA an antisense strand comprising the sequence of SEQ ID NO: 13984, or a nucleic acid sequence thereof having 3 or 4 nucleoside substitutions, additions, or deletions. In some embodiments, the siRNA an antisense strand comprising the sequence of SEQ ID NO: 13984, or a nucleic acid sequence thereof having 1 or 2 nucleoside substitutions, additions, or deletions. In some embodiments, the siRNA an antisense strand comprising the sequence of SEQ ID NO: 13984. In some embodiments, the antisense strand comprises one or more internucleoside linkages and/or nucleoside modifications.

In some embodiments, the siRNA a sense strand comprising the sequence of SEQ ID NO: 13977, or a nucleic acid sequence thereof having 3 or 4 nucleoside substitutions, additions, or deletions. In some embodiments, the siRNA a sense strand comprising the sequence of SEQ ID NO: 13977, or a nucleic acid sequence thereof having 1 or 2 nucleoside substitutions, additions, or deletions. In some embodiments, the siRNA a sense strand comprising the sequence of SEQ ID NO: 13977. In some embodiments, the sense strand comprises one or more internucleoside linkages and/or nucleoside modifications. In some embodiments, the siRNA an antisense strand comprising the sequence of SEQ ID NO: 13985, or a nucleic acid sequence thereof having 3 or 4 nucleoside substitutions, additions, or deletions. In some embodiments, the siRNA an antisense strand comprising the sequence of SEQ ID NO: 13985, or a nucleic acid sequence thereof having 1 or 2 nucleoside substitutions, additions, or deletions. In some embodiments, the siRNA an antisense strand comprising the sequence of SEQ ID NO: 13985. In some embodiments, the antisense strand comprises one or more internucleoside linkages and/or nucleoside modifications.

In some embodiments, the composition comprises an oligonucleotide that inhibits the expression of ANGPTL4, wherein the oligonucleotide comprises an siRNA comprising a sense strand and an antisense strand, wherein the antisense strand comprises a seed region that is not identical to a seed region of a human miRNA. In some embodiments, the composition comprises an oligonucleotide that inhibits the expression of ANGPTL4, wherein the oligonucleotide comprises an siRNA comprising a sense strand and an antisense strand, wherein the sense strand comprises a seed region that is not identical to a seed region of a human miRNA. In some embodiments, the siRNA is cross-reactive with a non-human primate (NHP) ANGPTL4 mRNA. For example, the antisense strand may bind to, or be complementary with, the NHP ANGPTL4 mRNA.

B. ASOs

In some embodiments, the composition comprises an oligonucleotide that inhibits the expression of ANGPTL4, wherein the oligonucleotide comprises an antisense oligonucleotide (ASO). In some embodiments, the ASO is 12-30 nucleosides in length. In some embodiments, the ASO is 14-30 nucleosides in length. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length.

In some embodiments, the composition comprises an oligonucleotide that inhibits the expression of ANGPTL4, wherein the oligonucleotide comprises an antisense oligonucleotide (ASO) about 12-30 nucleosides in length and comprising a nucleoside sequence complementary to about 12-30 contiguous nucleosides of a full-length human ANGPTL4 mRNA sequence such as SEQ ID NO: 13935; wherein (i) the oligonucleotide comprises a modification comprising a modified nucleoside and/or a modified internucleoside linkage, and/or (ii) the composition comprises a pharmaceutically acceptable carrier.

In some embodiments, the composition comprises an oligonucleotide that inhibits the expression of ANGPTL4, wherein the oligonucleotide comprises an ASO about 12-30 nucleosides in length and comprising a nucleoside sequence complementary to about 12-30 contiguous nucleosides of a full-length human ANGPTL4 mRNA sequence such as SEQ ID NO: 13936; wherein (i) the oligonucleotide comprises a modification comprising a modified nucleoside and/or a modified internucleoside linkage, and/or (ii) the composition comprises a pharmaceutically acceptable carrier.

In some embodiments, the composition comprises an oligonucleotide that inhibits the expression of ANGPTL4, wherein the oligonucleotide comprises an ASO that comprises a nucleoside sequence comprising or consisting of the sequence of any one of SEQ ID NOs: 3709-13934. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions. In some embodiments, the ASO comprises a nucleoside sequence comprising or consisting of the sequence of any one of SEQ ID NOs: 3709-13934, or a nucleic acid sequence thereof having 3 or 4 nucleoside substitutions, additions, or deletions.

C. Modification Patterns

In some embodiments, the composition comprises an oligonucleotide that inhibits the expression of ANGPTL4, wherein the oligonucleotide comprises a modification comprising a modified nucleoside and/or a modified internucleoside linkage, and/or (ii) the composition comprises a pharmaceutically acceptable carrier. In some embodiments, the oligonucleotide comprises a modification comprising a modified nucleoside and/or a modified internucleoside linkage. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. Benefits of the modified internucleoside linkage may include decreased toxicity or improved pharmacokinetics.

In some embodiments, the composition comprises an oligonucleotide that inhibits the expression of ANGPTL4, wherein the oligonucleotide comprises a modified internucleoside linkage, wherein the oligonucleotide comprises 1, 2, 3, 4, 5, 6, 7, 8, 9, 10, 11, 12, 13, 14, 15, 16, 17, 18, 19, or 20 modified internucleoside linkages, or a range of modified internucleoside linkages defined by any two of the aforementioned numbers. In some embodiments, the oligonucleotide comprises no more than 18 modified internucleoside linkages. In some embodiments, the oligonucleotide comprises no more than 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

In some embodiments, the composition comprises an oligonucleotide that inhibits the expression of ANGPTL4, wherein the oligonucleotide comprises the modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises HLA. In some embodiments, the modified nucleoside comprises CeNA. In some embodiments, the modified nucleoside comprises a 2'-methoxyethyl group. In some embodiments, the modified nucleoside comprises a 2'-O-alkyl group. In some embodiments, the modified nucleoside comprises a 2'-O-allyl group. In some embodiments, the modified nucleoside comprises a 2'-fluoro group. In some embodiments, the modified nucleoside comprises a 2'-deoxy group. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises a 2'-O-methyl nucleoside. In some embodiments, the modified nucleoside comprises a 2'-deoxyfluoro nucleoside. In some embodiments, the modified nucleoside comprises a 2'-O-NMA nucleoside. In some embodiments, the modified nucleoside comprises a 2'-O-DMAEOE nucleoside. In some embodiments, the modified nucleoside comprises a 2'-O-aminopropyl (2'-O-AP) nucleoside. In some embodiments, the modified nucleoside comprises 2'-ara-F. In some embodiments, the modified nucleoside comprises one or more 2'fluoro modified nucleosides. In some embodiments, the modified nucleoside comprises a 2' O-alkyl modified nucleoside. Benefits of the modified nucleoside may include decreased toxicity or improved pharmacokinetics.

In some embodiments, the oligonucleotide comprises 1, 2, 3, 4, 5, 6, 7, 8, 9, 10, 11, 12, 13, 14, 15, 16, 17, 18, 19, 20, or 21 modified nucleosides, or a range of nucleosides defined by any two of the aforementioned numbers. In some embodiments, the oligonucleotide comprises no more than 19 modified nucleosides. In some embodiments, the oligonucleotide comprises no more than 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

In some embodiments, the composition comprises an oligonucleotide that inhibits the expression of ANGPTL4, wherein the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof.

In some embodiments, the composition comprises an oligonucleotide that inhibits the expression of ANGPTL4, wherein the oligonucleotide comprises an N-acetylgalactosamine (GalNAc) ligand for hepatocyte targeting. A "GalNAc ligand" may be refer to a ligand for an asialoglycoprotein receptor (e.g. on a hepatocyte) that comprises one or more GalNAc moieties. The GalNAc ligand may bind an asialoglycoprotein receptor (e.g. on a hepatocyte). The GalNAc ligand may comprise one or more GalNAc moieties. An example of a GalNAc moiety includes GalNAc attached to a linker. The GalNAc ligand may comprise 3 GalNAc moieties. The GalNAc ligand may comprise 1, 2, 3, 4, 5, 6, 7, 8, 9, or 10, or more GalNAc moieties.

The GalNAc ligand may be conjugated to the oligonucleotide. The GalNAc ligand may be conjugated to a 5' end of the oligonucleotide. The GalNAc ligand may be conjugated to a 3' end of the oligonucleotide. A first GalNAc ligand may be conjugated to a 5' end of the oligonucleotide, and a second GalNAc ligand may be conjugated to 3' end of the oligonucleotide. The GalNAc ligand may be conjugated to a 3' or 5' end of an ASO. The GalNAc ligand may be conjugated to a 3' or 5' end of a sense strand of an siRNA. The GalNAc ligand may be conjugated to a 3' end of a sense strand of an siRNA. The GalNAc ligand may be conjugated to a 5' end of a sense strand of an siRNA. The GalNAc ligand may be conjugated to a 3' or 5' end of an antisense strand of an siRNA. The GalNAc ligand may be conjugated to a 3' end of an antisense strand of an siRNA. The GalNAc ligand may be conjugated to a 5' end of an antisense strand of an siRNA.

A first GalNAc ligand may be conjugated to a sense strand of an siRNA, and a second GalNAc ligand may be conjugated to an antisense strand of the siRNA.

1. siRNA Modification Patterns

In some embodiments, the sense strand comprises 1, 2, 3, 4, 5, 6, 7, 8, 9, 10, 11, 12, 13, 14, 15, 16, 17, 18, 19, 20, 21, 22, 23, 24, 25, 26, 27, 28, or 29 modified internucleoside linkages, or a range of modified internucleoside linkages defined by any two of the aforementioned integers. In some embodiments, the sense strand comprises 1-11 modified internucleoside linkages. In some embodiments, the sense strand comprises 2-6 modified internucleoside linkages. In some embodiments, the sense strand comprises 5 modified internucleoside linkages. In some embodiments, the sense strand comprises 4 modified internucleoside linkages.

In some embodiments, the antisense strand comprises 1, 2, 3, 4, 5, 6, 7, 8, 9, 10, 11, 12, 13, 14, 15, 16, 17, 18, 19, 20, 21, 22, 23, 24, 25, 26, 27, 28, or 29 modified internucleoside linkages, or a range of modified internucleoside linkages defined by any two of the aforementioned integers. In some embodiments, the antisense strand comprises 1-11 modified internucleoside linkages. In some embodiments, the antisense strand comprises 2-6 modified internucleoside linkages. In some embodiments, the antisense strand comprises 5 modified internucleoside linkages. In some embodiments, the antisense strand comprises 4 modified internucleoside linkages.

In some embodiments, the sense strand comprises 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 modified nucleosides, or a range of modified nucleosides defined by any two of the aforementioned integers. In some embodiments, the sense strand comprises 12-19 modified nucleosides. In some embodiments, the sense strand comprises 12-21 modified nucleosides. In some embodiments, the sense strand comprises 19 modified nucleosides. In some embodiments, the sense strand comprises 21 modified nucleosides.

In some embodiments, the antisense strand comprises 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 modified nucleosides, or a range of modified nucleosides defined by any two of the aforementioned integers. In some embodiments, the antisense strand comprises 12-19 modified nucleosides. In some embodiments, the antisense strand comprises 12-21 modified nucleosides. In some embodiments, the antisense strand comprises 19 modified nucleosides. In some embodiments, the antisense strand comprises 21 modified nucleosides.

In some embodiments, the sense strand or the antisense strand further comprises at least 2 additional nucleosides attached to a 3' terminus of the sense strand or the antisense strand. In some embodiments, the sense strand or the antisense strand comprises 2 additional nucleosides attached to a 3' terminus of the sense strand or the antisense strand. As part of the sense strand, the additional nucleosides may or may not be complementary to an ANGPTL4 mRNA. The additional nucleosides of the antisense strand may include a uracil. The 2 additional nucleosides of the antisense strand may both include uracil.

In some embodiments, the sense strand or the sense strand further comprises at least 2 additional nucleosides attached to a 3' terminus of the sense strand or the sense strand. In some embodiments, the sense strand or the sense strand comprises 2 additional nucleosides attached to a 3' terminus of the sense strand or the sense strand. The additional nucleosides of the sense strand may include a uracil. The 2 additional nucleosides of the sense strand may both include uracil.

In some embodiments, the composition comprises an oligonucleotide that inhibits the expression of ANGPTL4 wherein the oligonucleotide comprises an siRNA comprising a sense strand and an antisense strand, wherein the sense strand comprises modification pattern 1S: 5'-NfsnsNfnNfnNfNfNfnNfnNfnNfnNfnNfsnsn-3' (SEQ ID NO: 13954), wherein "Nf" is a 2' fluoro-modified nucleoside, "n" is a 2' O-methyl modified nucleoside, and "s" is a phosphorothioate linkage. In some embodiments, the sense strand comprises modification pattern 2S: 5'-nsnsnnNfnNffNfnnnnnnnnnnsnsn-3' (SEQ ID NO: 13955), wherein "Nf" is a 2' fluoro-modified nucleoside, "n" is a 2' O-methyl modified nucleoside, and "s" is a phosphorothioate linkage. In some embodiments, the sense strand comprises modification pattern 3S: 5'-nsnsnnNfnNfnNfnnnnnnnnnsnsn-3' (SEQ ID NO: 13956), wherein "Nf" is a 2' fluoro-modified nucleoside, "n" is a 2' O-methyl modified nucleoside, and "s" is a phosphorothioate linkage. In some embodiments, the sense strand comprises modification pattern 4S: 5'-NfsnsNfnNfnNfNfnNfnNfnNfnNfsnsnN-3' (SEQ ID NO: 13957), wherein "Nf" is a 2' fluoro-modified nucleoside, "n" is a 2' O-methyl modified nucleoside, "s" is a phosphorothioate linkage, and N comprises one or more nucleosides. In some embodiments, the sense strand comprises modification pattern 5S: 5'-nsnsnnNfnNfNfNfnnnnnnnnnsnsnN-3' (SEQ ID NO: 13958), wherein "Nf" is a 2' fluoro-modified nucleoside, "n" is a 2' O-methyl modified nucleoside, "s" is a phosphorothioate linkage, and N comprises one or more nucleosides. In some embodiments, the sense strand comprises modification pattern 6S: 5'-NfsnsNfnNfnNfnNfnNfnNfnNfnNfsnsn-3' (SEQ ID NO: 13959), wherein "Nf" is a 2' fluoro-modified nucleoside, "n" is a 2' O-methyl modified nucleoside, "s" is a phosphorothioate linkage, and N comprises one or more nucleosides. Any one of modification patterns 1S-6S may include a GalNAc ligand attached to the 3' end. Any one of modification patterns 1S-6S may include a GalNAc ligand attached to the 5' end.

In some embodiments, the composition comprises an oligonucleotide that inhibits the expression of ANGPTL4 wherein the oligonucleotide comprises an siRNA comprising a sense strand and an antisense strand, wherein the antisense strand comprises modification pattern 1AS: 5'-nsNfsnNfnNfnNfnNfnNfrmnNfnNfnNfsnsn-3' (SEQ ID NO: 13960), wherein "Nf" is a 2' fluoro-modified nucleoside, "n" is a 2' O-methyl modified nucleoside, and "s" is a phosphorothioate linkage. In some embodiments, the antisense strand comprises modification pattern 2AS: 5'-nsNfsnnnNfnNfNfnnnnNfnNfnnnsnsn-3' (SEQ ID NO: 13961), wherein "Nf" is a 2' fluoro-modified nucleoside, "n" is a 2' O-methyl modified nucleoside, and "s" is a phosphorothioate linkage. In some embodiments, the antisense strand comprises modification pattern 3AS: 5'-nsNfsnnnNfnnnnnnnNfnNfnnnsnsn-3' (SEQ ID NO: 13962), wherein "Nf" is a 2' fluoro-modified nucleoside, "n" is a 2' O-methyl modified nucleoside, and "s" is a phosphorothioate linkage. In some embodiments, the antisense strand comprises modification pattern 4AS: 5'-nsNfsnNfnNfnnnnnnnNfnNfnnnsnsn-3' (SEQ ID NO: 13963), wherein "Nf" is a 2' fluoro-modified nucleoside, "n" is a 2' O-methyl modified nucleoside, and "s" is a phosphorothioate linkage. In some embodiments, the antisense strand comprises modification pattern 5AS: 5'-nsNfsnnnNfnNfnNfnnnnnNfnNfnnnsnsn-3' (SEQ ID NO: 13964), wherein "Nf" is a 2' fluoro-modified nucleoside, "n" is a 2' O-methyl modified nucleoside, and "s" is a phosphorothioate linkage. In some embodiments, the antisense strand comprises modification pattern 6AS: 5'-nsNfsnNfnNfnNfnNfnNfnNfnNfnNfnsnsn-3' (SEQ ID NO: 13965), wherein "Nf" is a 2' fluoro-modified nucleoside, "n" is a 2' O-methyl modified nucleoside, and "s" is a phosphorothioate linkage. In some embodiments, the antisense strand comprises modification pattern 7AS: 5'-nsNfsnNfnNfnNfnNfNfnnnnNfnNfnnnsnsn-3' (SEQ ID NO: 13966), wherein "Nf" is a 2' fluoro-modified nucleoside, "n" is a 2' O-methyl modified nucleoside, and "s" is a phosphorothioate linkage. In some embodiments, the antisense strand comprises modification pattern 8AS: 5'-nsNfsnnnnnnnnnnnnNfnrmnnsnsn-3' (SEQ ID NO: 13967), wherein "Nf" is a 2' fluoro-modified nucleoside, "n" is a 2' O-methyl modified nucleoside, and "s" is a phosphorothioate linkage. In some embodiments, the antisense strand comprises modification pattern 9AS: 5'-nsNfsnnnNfnnnnnnnnNfnNfnNfnsnsn-3' (SEQ ID NO: 13968), wherein "Nf" is a 2' fluoro-modified nucleoside, "n" is a 2' O-methyl modified nucleoside, and "s" is a phosphorothioate linkage. Any one of modification patterns 1AS-9AS may include a GalNAc ligand attached to the 3' end. Any one of modification patterns 1AS-9AS may include a GalNAc ligand attached to the 5' end.

In some embodiments, the composition comprises an oligonucleotide that inhibits the expression of ANGPTL4 wherein the oligonucleotide comprises an siRNA comprising a sense strand and an antisense strand, wherein the sense strand comprises modification pattern 1S and the antisense strand comprises modification pattern 1AS, 2AS, 3AS, 4AS, 5AS, 6AS, 7AS, 8AS, or 9AS. In some embodiments, the sense strand comprises modification pattern 2S and the antisense strand comprises modification pattern 1AS, 2AS, 3AS, 4AS, 5AS, 6AS, 7AS, 8AS, or 9AS. In some embodiments, the sense strand comprises modification pattern 3S and the antisense strand comprises modification pattern 1AS, 2AS, 3AS, 4AS, 5AS, 6AS, 7AS, 8AS, or 9AS. In some embodiments, the sense strand comprises modification pattern 4S and the antisense strand comprises modification pattern 1AS, 2AS, 3AS, 4AS, 5AS, 6AS, 7AS, 8AS, or 9AS. In some embodiments, the sense strand comprises modification pattern 5S and the antisense strand comprises modification pattern 1AS, 2AS, 3AS, 4AS, 5AS, 6AS, 7AS, 8AS, or 9AS. In some embodiments, the sense strand comprises modification pattern 6S and the antisense strand comprises modification pattern 1AS, 2AS, 3AS, 4AS, 5AS, 6AS, 7AS, 8AS, or 9AS. In some embodiments, the sense strand comprises modification pattern 1AS, 2AS, 3AS, 4AS, 5AS, 6AS, 7AS, 8AS, or 9AS. In some embodiments, the antisense strand comprises modification pattern 1AS, 2AS, 3AS, 4AS, 5AS, 6AS, 7AS, 8AS, or 9AS. In some embodiments, the sense strand or the antisense strand comprises modification pattern ASO1.

Any combination of sense and antisense modification patterns may be used. In some embodiments, the sense strand comprises modification pattern 1S, and the antisense strand comprises modification pattern 1AS. In some embodiments, the sense strand comprises modification pattern 2S, and the antisense strand comprises modification pattern 2AS. In some embodiments, the sense strand comprises modification pattern 2S, and the antisense strand comprises modification pattern 3AS. In some embodiments, the sense strand comprises modification pattern 3S, and the antisense strand comprises modification pattern 1AS. In some embodiments, the sense strand comprises modification pattern 3S, and the antisense strand comprises modification pattern 4AS. In some embodiments, the sense strand comprises modification pattern 3S, and the antisense strand comprises modification pattern 5AS. In some embodiments, the sense strand comprises modification pattern 3S, and the antisense strand comprises modification pattern 6AS. In some embodiments, the sense strand comprises modification pattern 3S, and the antisense strand comprises modification pattern 7AS. In some embodiments, the sense strand comprises modification pattern 3S, and the antisense strand comprises modification pattern 8AS. In some embodiments, the sense strand comprises modification pattern 6S, and the antisense strand comprises modification pattern 1AS. In some embodiments, the sense strand comprises modification pattern 6S, and the antisense strand comprises modification pattern 4AS. In some embodiments, the sense strand comprises modification pattern 6S, and the antisense strand comprises modification pattern 5AS. In some embodiments, the sense strand comprises modification pattern 6S, and the antisense strand comprises modification pattern 6AS. In some embodiments, the sense strand comprises modification pattern 6S, and the antisense strand comprises modification pattern 7AS. In some embodiments, the sense strand comprises modification pattern 6S, and the antisense strand comprises modification pattern 8AS.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 1S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 1S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 1S.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 2S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 2S.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 3S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 3S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 3S.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 4S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 4S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 4S.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 5S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 5S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 5S.

In some embodiments, the composition comprises an oligonucleotide that inhibits the expression of ANGPTL4 wherein the oligonucleotide comprises an siRNA comprising a sense strand and an antisense strand, wherein the sense strand comprises a nucleoside sequence comprising or consisting of the sequence of any one of SEQ ID NOs: 1-1854 or 13970-13977, and modification pattern 6S. In some embodiments, the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 6S. In some embodiments, the sense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 6S.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 1AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 1AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 1AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 2AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 2AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 3AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 3AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 3AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 4AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 4AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 4AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 5AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 5AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 5AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 6AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 6AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 6AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 7AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 7AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 7AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 8AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 8AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 8AS.

In some embodiments, the composition comprises an oligonucleotide that inhibits the expression of ANGPTL4 wherein the oligonucleotide comprises an siRNA comprising a sense strand and an antisense strand, wherein the antisense strand comprises a nucleoside sequence comprising or consisting of the sequence of any one of SEQ ID NOs: 1-1854 or 13970-13977, and modification pattern 9AS. In some embodiments, the antisense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 9AS. In some embodiments, the antisense strand comprises a nucleoside sequence comprising or consisting of the sequence of any one of SEQ ID NOs: 1-1854 or 13970-13977, or a nucleic acid sequence thereof having 3 or 4 nucleoside substitutions, additions, or deletions, and modification pattern 9AS.

In some embodiments, the sense strand comprises a nucleoside sequence comprising or consisting the sequence of any one of SEQ ID NOs: 1-1854 or 13970-13977, an overhang (such as a 2 base 3' overhang), and modification pattern 1S. In some embodiments, the sense strand comprises a nucleoside sequence comprising or consisting the sequence of any one of SEQ ID NOs: 1-1854 or 13970-13977, an overhang (such as a 2 base 3' overhang), and modification pattern 2S. In some embodiments, the sense strand comprises a nucleoside sequence comprising or consisting the sequence of any one of SEQ ID NOs: 1-1854 or 13970-13977, an overhang (such as a 2 base 3' overhang), and modification pattern 3S. In some embodiments, the sense strand comprises a nucleoside sequence comprising or consisting the sequence of any one of SEQ ID NOs: 1-1854 or 13970-13977, an overhang (such as a 2 base 3' overhang), and modification pattern 4S. In some embodiments, the sense strand comprises a nucleoside sequence comprising or consisting the sequence of any one of SEQ ID NOs: 1-1854 or 13970-13977, an overhang (such as a 2 base 3' overhang), and modification pattern 5S. In some embodiments, the sense strand comprises a nucleoside sequence comprising or consisting the sequence of any one of SEQ ID NOs: 1-1854 or 13970-13977, an overhang (such as a 2 base 3' overhang), and modification pattern 6S. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 1AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 2AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 3AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 4AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 5AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 6AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 7AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 8AS. In some embodiments, the antisense strand comprises a nucleoside sequence comprising or consisting of the sequence of any one of SEQ ID NOs: 1855-3708 or 13978-13985, and an overhang (such as a 2 base 3' overhang), and modification pattern 9AS. In some embodiments, the overhang comprises one or more uracil nucleosides. In some embodiments, the one or more uracil nucleosides of the overhang are connected at the 3' end to another nucleoside via a phosphorothioate linkage. In some embodiments, the overhang comprises one uracil nucleoside. In some embodiments, the overhang comprises two uracil nucleoside.

Some embodiments include a composition comprising an oligonucleotide that targets Angiopoietin like 4 (ANGPTL4) and when administered to a cell decreases expression of ANGPTL4, wherein the oligonucleotide comprises a small interfering RNA (siRNA) comprising a sense strand and an antisense strand, wherein the sense strand comprises an oligonucleotide sequence of SEQ ID NOs: 759, 1285, 1580, or 1840 in which at least one internucleoside linkage is modified and at least one base is modified, or an oligonucleotide sequence comprising 1 or 2 nucleoside, substitutions, additions, or deletions of SEQ ID NOs: 759, 1285, 1580, or 1840 in which at least one internucleoside linkage is modified and at least one base is modified, and wherein the antisense strand comprises an oligonucleotide sequence of SEQ ID NOs: 2613, 3139, 3434, or 3694 in which at least one internucleoside linkage is modified and at least one base is modified, or an oligonucleotide sequence comprising 1 or 2 nucleoside, substitutions, additions, or deletions of SEQ ID NOs: 2613, 3139, 3434, or 3694 in which at least one internucleoside linkage is modified and at least one base is modified.

Some embodiments include a composition comprising an oligonucleotide that targets Angiopoietin like 4 (ANGPTL4) and when administered to a cell decreases expression of ANGPTL4, wherein the oligonucleotide comprises a small interfering RNA (siRNA) comprising a sense strand and an antisense strand, wherein the sense strand comprises an oligonucleotide sequence of any one of SEQ ID NOs: 13970-13973 in which at least one internucleoside linkage is modified and at least one base is modified, or an oligonucleotide sequence comprising 1 or 2 nucleoside, substitutions, additions, or deletions of any one of SEQ ID NOs: 13970-13973 in which at least one internucleoside linkage is modified and at least one base is modified, and wherein the antisense strand comprises an oligonucleotide sequence of any one of SEQ ID NOs: 13978-13981 in which at least one internucleoside linkage is modified and at least one base is modified, or an oligonucleotide sequence comprising 1 or 2 nucleoside, substitutions, additions, or deletions of any one of SEQ ID NOs: 13978-13981 in which at least one internucleoside linkage is modified and at least one base is modified.

Some embodiments include a composition comprising an oligonucleotide that targets Angiopoietin like 4 (ANGPTL4) and when administered to a cell decreases expression of ANGPTL4, wherein the oligonucleotide comprises a small interfering RNA (siRNA) comprising a sense strand and an antisense strand, wherein the sense strand comprises an oligonucleotide sequence of any one of SEQ ID NOs: 13974-13977 in which at least one internucleoside linkage is modified and at least one base is modified, or an oligonucleotide sequence comprising 1 or 2 nucleoside, substitutions, additions, or deletions of any one of SEQ ID NOs: 13974-13977 in which at least one internucleoside linkage is modified and at least one base is modified, and wherein the antisense strand comprises an oligonucleotide sequence of any one of SEQ ID NOs: 13982-13985 in which at least one internucleoside linkage is modified and at least one base is modified, or an oligonucleotide sequence comprising 1 or 2 nucleoside, substitutions, additions, or deletions of any one of SEQ ID NOs: 13982-13985 in which at least one internucleoside linkage is modified and at least one base is modified.

Some embodiments include a composition comprising an oligonucleotide that targets Angiopoietin like 4 (ANGPTL4) and when administered to a cell decreases expression of ANGPTL4, wherein the oligonucleotide comprises a small interfering RNA (siRNA) comprising a sense strand and an antisense strand, wherein the sense strand comprises an oligonucleotide sequence of any one of SEQ ID NOs: 13990-14005 in which at least one internucleoside linkage is modified and at least one base is modified, or an oligonucleotide sequence comprising 1 or 2 nucleoside, substitutions, additions, or deletions of any one of SEQ ID NOs: 13990-14005 in which at least one internucleoside linkage is modified and at least one base is modified, and wherein the antisense strand comprises an oligonucleotide sequence of any one of SEQ ID NOs: 14134-14157 in which at least one internucleoside linkage is modified and at least one base is modified, or an oligonucleotide sequence comprising 1 or 2 nucleoside, substitutions, additions, or deletions of any one of SEQ ID NOs: 14134-14157 in which at least one internucleoside linkage is modified and at least one base is modified.

Some embodiments include a composition comprising an oligonucleotide that targets Angiopoietin like 4 (ANGPTL4) and when administered to a cell decreases expression of ANGPTL4, wherein the oligonucleotide comprises a small interfering RNA (siRNA) comprising a sense strand and an antisense strand, wherein the sense strand comprises an oligonucleotide sequence of any one of SEQ ID NOs: 1-1854 in which at least one internucleoside linkage is modified and at least one base is modified, or an oligonucleotide sequence comprising 1 or 2 nucleoside, substitutions, additions, or deletions of any one of SEQ ID NOs: 1-1854 in which at least one internucleoside linkage is modified and at least one base is modified, and wherein the antisense strand comprises an oligonucleotide sequence of any one of SEQ ID NOs: 1855-3708 in which at least one internucleoside linkage is modified and at least one base is modified, or an oligonucleotide sequence comprising 1 or 2 nucleoside, substitutions, additions, or deletions of any one of SEQ ID NOs: 1855-3708 in which at least one internucleoside linkage is modified and at least one base is modified.

2. ASO Modification Patterns

In some embodiments, the composition comprises an oligonucleotide that inhibits the expression of ANGPTL4, wherein the oligonucleotide comprises an antisense oligonucleotide (ASO). In some embodiments, the ASO comprises modification pattern ASO1: 5'-nsnsnsnsnsdNsdNsdNsdNsdNsdNsdNsdNsdNsnsnsnsnsn-3', wherein "dN" is any deoxynucleotide, "n" is a 2'O-methyl or 2'O-methoxyethyl-modified nucleoside, and "s" is a phosphorothioate linkage. In some embodiments, the ASO comprises modification pattern 1S, 2S, 3S, 4S, 5S, 6S, 1AS, 2AS, 3AS, 4AS, 5AS, 6AS, 7AS, 8AS, or 9AS. In some embodiments, the ASO comprises DNA.

In some embodiments, the composition comprises an oligonucleotide that inhibits the expression of ANGPTL4, wherein the oligonucleotide comprises an antisense oligonucleotide (ASO). In some embodiments, the ASO comprises a nucleoside sequence comprising or consisting of the sequence of any one of SEQ ID NOs: 3709-13934, and modification pattern ASO1. In some embodiments, the ASO comprises a nucleoside sequence comprising or consisting of the sequence of any one of SEQ ID NOs: 3709-13934, or a nucleic acid sequence thereof having 1 or 2 nucleoside substitutions, additions, or deletions, and modification pattern ASO1. In some embodiments, the ASO comprises a nucleoside sequence comprising or consisting of the sequence of any one of SEQ ID NOs: 3709-13934, or a nucleic acid sequence thereof having 3 or 4 nucleoside substitutions, additions, or deletions, and modification pattern ASO1.

ASO1 modification pattern ASO1 may include a GalNAc ligand attached to the 3' end. ASO1 modification pattern ASO1 may include a GalNAc ligand attached to the 5' end.

D. Formulations

In some embodiments, the composition is a pharmaceutical composition. In some embodiments, the composition is sterile. In some embodiments, the composition further comprises a pharmaceutically acceptable carrier.

In some embodiments, the pharmaceutically acceptable carrier comprises water. In some embodiments, the pharmaceutically acceptable carrier comprises a buffer. In some embodiments, the pharmaceutically acceptable carrier comprises a saline solution. In some embodiments, the pharmaceutically acceptable carrier comprises water, a buffer, or a saline solution. In some embodiments, the composition comprises a liposome. In some embodiments, the pharmaceutically acceptable carrier comprises liposomes, lipids, nanoparticles, proteins, protein-antibody complexes, peptides, cellulose, nanogel, or a combination thereof.

II. Methods and Uses

Disclosed herein, in some embodiments, are methods of administering a composition described herein to a subject. Some embodiments relate to use a composition described herein, such as administering the composition to a subject.

Some embodiments relate to a method of treating a disorder in a subject in need thereof. Some embodiments relate to use of a composition described herein in the method of treatment. Some embodiments include administering a composition described herein to a subject with the disorder. In some embodiments, the administration treats the disorder in the subject. In some embodiments, the composition treats the disorder in the subject.

In some embodiments, the treatment comprises prevention, inhibition, or reversion of the disorder in the subject. Some embodiments relate to use of a composition described herein in the method of preventing, inhibiting, or reversing the disorder. Some embodiments relate to a method of preventing, inhibiting, or reversing a disorder a disorder in a subject in need thereof. Some embodiments include administering a composition described herein to a subject with the disorder. In some embodiments, the administration prevents, inhibits, or reverses the disorder in the subject. In some embodiments, the composition prevents, inhibits, or reverses the disorder in the subject.

Some embodiments relate to a method of preventing a disorder a disorder in a subject in need thereof. Some embodiments relate to use of a composition described herein in the method of preventing the disorder. Some embodiments include administering a composition described herein to a subject with the disorder. In some embodiments, the administration prevents the disorder in the subject. In some embodiments, the composition prevents the disorder in the subject.

Some embodiments relate to a method of inhibiting a disorder a disorder in a subject in need thereof. Some embodiments relate to use of a composition described herein in the method of inhibiting the disorder. Some embodiments include administering a composition described herein to a subject with the disorder. In some embodiments, the administration inhibits the disorder in the subject. In some embodiments, the composition inhibits the disorder in the subject.

Some embodiments relate to a method of reversing a disorder a disorder in a subject in need thereof. Some embodiments relate to use of a composition described herein in the method of reversing the disorder. Some embodiments include administering a composition described herein to a subject with the disorder. In some embodiments, the administration reverses the disorder in the subject. In some embodiments, the composition reverses the disorder in the subject.

A. Disorders

Some embodiments of the methods described herein include treating a disorder in a subject in need thereof. In some embodiments, the disorder is a metabolic disorder. Examples of metabolic disorders include hyperlipidemia (for example, hypertriglyceridemia) and diabetes (for example, type II diabetes). In some embodiments, the metabolic disorder comprises hyperlipidemia. In some embodiments, the metabolic disorder comprises hypertriglyceridemia. In some embodiments, the metabolic disorder comprises familial chylomicronemia. In some embodiments, the metabolic disorder comprises hypertriglyceridemia in the context of familial chylomicronemia. In some embodiments, the metabolic disorder comprises pancreatitis. In some embodiments, the metabolic disorder comprises acute pancreatitis. In some embodiments, the metabolic disorder comprises hypertriglyceridemia and associated acute pancreatitis. In some embodiments, the metabolic disorder comprises diabetes. In some embodiments, the metabolic disorder comprises type 2 diabetes. Some embodiments include a method of treating a metabolic disorder in a subject in need thereof, the method comprising administering to the subject a composition comprising an oligonucleotide that targets ANGPTL4.

In some embodiments, the disorder is a cardiometabolic disorder such as a cardiovascular disorder or a metabolic disorder. In some embodiments, the disorder is a cardiovascular disorder. Examples of cardiovascular disorders include heart disease, myocardial infarction, angina (for example, angina pectoris), and atherosclerosis. In some embodiments, the cardiovascular disorder comprises heart disease. In some embodiments, the cardiovascular disorder comprises myocardial infarction. In some embodiments, the cardiovascular disorder comprises angina pectoris. In some embodiments, the cardiovascular disorder comprises atherosclerosis. Some embodiments include a method of treating a cardiovascular disorder in a subject in need thereof, the method comprising administering to the subject a composition comprising an oligonucleotide that targets ANGPTL4.

B. Subjects

Some embodiments of the methods described herein include treatment of a subject. Examples of subjects include vertebrates, animals, mammals, dogs, cats, cattle, rodents, mice, rats, primates, monkeys, and humans. In some embodiments, the subject is a vertebrate. In some embodiments, the subject is an animal. In some embodiments, the subject is a mammal. In some embodiments, the subject is a dog. In some embodiments, the subject is a cat. In some embodiments, the subject is a cattle. In some embodiments, the subject is a mouse. In some embodiments, the subject is a rat. In some embodiments, the subject is a primate. In some embodiments, the subject is a monkey. In some embodiments, the subject is an animal, a mammal, a dog, a cat, cattle, a rodent, a mouse, a rat, a primate, or a monkey. In some embodiments, the subject is a human.

In some embodiments, the subject has a body mass index (BMI) of 25, 26, 27, 28, 29, 30, 31, 32, 33, 34, 35, 36, 37, 38, 39, 40, 41, 42, 43, 44, 45, 46, 47, 48, 49, 50, or more, or a range defined by any two of the aforementioned integers. In some embodiments, the subject is overweight. In some embodiments, the subject has a BMI of 25 or more. In some embodiments, the subject has a BMI of 25-29. In some embodiments, the subject is obese. In some embodiments, the subject has a BMI of 30 or more. In some embodiments, the subject has a BMI of 30-39. In some embodiments, the subject has a BMI of 40-50. In some embodiments, the subject has a BMI of 25-50.

In some embodiments, the subject is ≥90 years of age. In some embodiments, the subject is ≥85 years of age. In some embodiments, the subject is ≥80 years of age. In some embodiments, the subject is ≥70 years of age. In some embodiments, the subject is ≥60 years of age. In some embodiments, the subject is ≥50 years of age. In some embodiments, the subject is ≥40 years of age. In some embodiments, the subject is ≥30 years of age. In some embodiments, the subject is ≥20 years of age. In some embodiments, the subject is ≥10 years of age. In some embodiments, the subject is ≥1 years of age. In some embodiments, the subject is ≥0 years of age.

In some embodiments, the subject is ≤100 years of age. In some embodiments, the subject is ≤90 years of age. In some embodiments, the subject is ≤85 years of age. In some embodiments, the subject is ≤80 years of age. In some embodiments, the subject is ≤70 years of age. In some embodiments, the subject is ≤60 years of age. In some embodiments, the subject is ≤50 years of age. In some embodiments, the subject is ≤40 years of age. In some embodiments, the subject is ≤30 years of age. In some embodiments, the subject is ≤20 years of age. In some embodiments, the subject is ≤10 years of age. In some embodiments, the subject is ≤1 years of age.

In some embodiments, the subject is between 0 and 100 years of age. In some embodiments, the subject is between 20 and 90 years of age. In some embodiments, the subject is between 30 and 80 years of age. In some embodiments, the subject is between 40 and 75 years of age. In some embodiments, the subject is between 50 and 70 years of age. In some embodiments, the subject is between 40 and 85 years of age.

C. Baseline Measurements

Some embodiments of the methods described herein include obtaining a baseline measurement from a subject. For example, in some embodiments, a baseline measurement is obtained from the subject prior to treating the subject.

In some embodiments, the baseline measurement is obtained by performing an assay such as an immunoassay, a colorimetric assay, or a fluorescence assay, on the sample obtained from the subject. In some embodiments, the baseline measurement is obtained by an immunoassay, a colorimetric assay, or a fluorescence assay. In some embodiments, the baseline measurement is obtained by PCR.

In some embodiments, the baseline measurement is a baseline triglyceride measurement. In some embodiments, the baseline triglyceride measurement is a baseline triglyceride concentration (for example, mg/dL). In some embodiments, the baseline triglyceride measurement is a baseline circulating triglyceride measurement. In some embodiments, the baseline triglyceride measurement is obtained by an assay such as an immunoassay, a colorimetric assay, or a fluorescence assay.

In some embodiments, the baseline measurement is a baseline cholesterol measurement. In some embodiments, the baseline cholesterol measurement is a baseline cholesterol concentration. In some embodiments, the baseline cholesterol concentration is a baseline total cholesterol concentration. In some embodiments, the baseline cholesterol measurement is a baseline circulating cholesterol measurement. In some embodiments, the baseline cholesterol measurement is a baseline low density lipoprotein (LDL) measurement. In some embodiments, the baseline cholesterol measurement is a baseline very low density lipoprotein (VLDL) measurement. In some embodiments, the baseline cholesterol measurement is obtained by an assay such as an immunoassay, a colorimetric assay, or a fluorescence assay.

In some embodiments, the baseline measurement is a baseline HDL measurement. In some embodiments, the baseline HDL measurement is a baseline HDL concentration. In some embodiments, the baseline HDL measurement is indicated relative to a baseline total cholesterol measurement. In some embodiments, the baseline HDL measurement is a baseline circulating HDL measurement. In some embodiments, the baseline HDL measurement is obtained by an assay such as an immunoassay, a colorimetric assay, or a fluorescence assay.

In some embodiments, the baseline measurement is a baseline glucose measurement. In some embodiments, the baseline glucose measurement is a baseline glucose concentration (for example, mg/dL). In some embodiments, the baseline glucose measurement comprises a baseline glucose concentration. In some embodiments, the baseline glucose measurement is a baseline circulating glucose measurement. In some embodiments, the baseline glucose measurement is obtained by an assay such as an immunoassay, a colorimetric assay, or a fluorescence assay. In some embodiments, the baseline glucose measurement is obtained In some embodiments, the baseline glucose measurement comprises a baseline glucose tolerance test. In some embodiments, the baseline glucose tolerance test comprises administering glucose to the subject, and then obtaining multiple baseline glucose measurements over time after administering the glucose to the subject. In some embodiments, the glucose is administered orally. In some embodiments, the glucose is administered by injection. In some embodiments, the multiple baseline glucose measurements are integrated into a baseline glucose area under the curve (AUC) measurement. In some embodiments, the baseline glucose tolerance test is performed on the subject in a fasted state such as after an overnight fast. In some embodiments, the baseline glucose measurement comprises a baseline glucose measurement other than a baseline glucose tolerance test.

In some embodiments, the baseline measurement is a baseline insulin measurement. In some embodiments, the baseline insulin measurement is a baseline insulin sensitivity measurement. In some embodiments, the baseline insulin sensitivity measurement is obtained using a glucose clamp technique such as a hyperinsulinemic euglycemic clamp. In some embodiments, the baseline insulin measurement is a baseline insulin concentration. In some embodiments, the baseline insulin measurement comprises a baseline insulin concentration. In some embodiments, the baseline insulin measurement is a baseline circulating insulin measurement. In some embodiments, the baseline insulin measurement is obtained by an assay such as an immunoassay (for example, an ELISA or an immunoblot), a colorimetric assay, or a fluorescence assay. In some embodiments, the baseline insulin sensitivity measurement comprises a baseline glucose tolerance test. In some embodiments, the baseline insulin sensitivity measurement comprises a baseline insulin sensitivity measurement other than a baseline glucose tolerance test.

In some embodiments, the baseline insulin measurement comprises a baseline insulin response test. In some embodiments, the baseline insulin response test comprises administering glucose to the subject and then obtaining multiple baseline insulin measurements over time after administering the glucose to the subject. In some embodiments, the glucose is administered orally. In some embodiments, the glucose is administered by injection. In some embodiments, the multiple baseline insulin measurements are integrated into a baseline insulin AUC measurement. In some embodiments, the baseline insulin response test is performed on the subject in a fasted state such as after an overnight fast.

In some embodiments, the baseline insulin measurement comprises a baseline glucose response test. In some embodiments, the baseline glucose response test comprises administering insulin to the subject, and then obtaining multiple baseline glucose measurements over time after administering the insulin to the subject. In some embodiments, the insulin is administered by injection. In some embodiments, the multiple baseline glucose measurements are integrated into a baseline glucose AUC measurement. In some embodiments, the multiple baseline glucose measurements are obtained with a glucometer. In some embodiments, the glucose response test is performed on the subject in a fasted state such as after an overnight fast. In some embodiments, the glucose response test is performed on the subject after administering food, drink, or glucose to the subject.

In some embodiments, the baseline measurement is a baseline ANGPTL4 protein measurement. In some embodiments, the baseline ANGPTL4 protein measurement comprises a baseline ANGPTL4 protein level. In some embodiments, the baseline ANGPTL4 protein level is indicated as a mass or percentage of ANGPTL4 protein per sample weight. In some embodiments, the baseline ANGPTL4 protein level is indicated as a mass or percentage of ANGPTL4 protein per sample volume. In some embodiments, the baseline ANGPTL4 protein level is indicated as a mass or percentage of ANGPTL4 protein per total protein within the sample. In some embodiments, the baseline ANGPTL4 protein measurement is a baseline cell (e.g. hepatocyte) ANGPTL4 protein measurement. In some embodiments, the baseline ANGPTL4 protein measurement is a baseline tissue (e.g. liver tissue) ANGPTL4 protein measurement. In some embodiments, the baseline ANGPTL4 protein measurement is a baseline circulating ANGPTL4 protein measurement. In some embodiments, the baseline ANGPTL4 protein measurement is obtained by an assay such as an immunoassay, a colorimetric assay, or a fluorescence assay.

In some embodiments, the baseline measurement is a baseline ANGPTL4 mRNA measurement. In some embodiments, the baseline ANGPTL4 mRNA measurement comprises a baseline ANGPTL4 mRNA level. In some embodiments, the baseline ANGPTL4 mRNA level is indicated as a mass or percentage of ANGPTL4 mRNA per sample weight. In some embodiments, the baseline ANGPTL4 mRNA level is indicated as a mass or percentage of ANGPTL4 mRNA per sample volume. In some embodiments, the baseline ANGPTL4 mRNA level is indicated as a mass or percentage of ANGPTL4 mRNA per total mRNA within the sample. In some embodiments, the baseline ANGPTL4 mRNA level is indicated as a mass or percentage of ANGPTL4 mRNA per total nucleic acids within the sample. In some embodiments, the baseline ANGPTL4 mRNA level is indicated relative to another mRNA level, such as an mRNA level of a housekeeping gene, within the sample. In some embodiments, the baseline ANGPTL4 mRNA measurement is obtained by an assay such as a polymerase chain reaction (PCR) assay. In some embodiments, the PCR comprises quantitative PCR (qPCR). In some embodiments, the PCR comprises reverse transcription of the ANGPTL4 mRNA.

Some embodiments of the methods described herein include obtaining a sample from a subject. In some embodiments, the baseline measurement is obtained in a sample obtained from the subject. In some embodiments, the sample is obtained from the subject prior to administration or treatment of the subject with a composition described herein. In some embodiments, a baseline measurement is obtained in a sample obtained from the subject prior to administering the composition to the subject. In some embodiments, the sample is obtained from the subject in a fasted state. In some embodiments, the sample is obtained from the subject after an overnight fasting period. In some embodiments, the sample is obtained from the subject in a fed state.

In some embodiments, the sample comprises a fluid. In some embodiments, the sample is a fluid sample. In some embodiments, the sample is a blood, plasma, or serum sample. In some embodiments, the sample comprises blood. In some embodiments, the sample is a blood sample. In some embodiments, the sample is a whole-blood sample. In some embodiments, the blood is fractionated or centrifuged. In some embodiments, the sample comprises plasma. In some embodiments, the sample is a plasma sample. In some embodiments, the sample comprises serum. In some embodiments, the sample is a serum sample. For example, the baseline triglyceride 33measurement, the baseline cholesterol measurement, the baseline HDL measurement, the baseline glucose measurement, the baseline insulin measurement, or the baseline ANGPTL4 protein measurement may be obtained in a serum sample from the patient.

In some embodiments, the sample comprises a tissue. In some embodiments, the sample is a tissue sample. In some embodiments, the sample comprises liver tissue. In some embodiments, the sample is a liver sample. In some embodiments, the sample comprises adipose tissue. In some embodiments, the sample is an adipose sample. In some embodiments, the sample comprises pancreatic tissue. In some embodiments, the sample comprises a pancreas sample. For example, the baseline ANGPTL4 mRNA measurement, or the baseline ANGPTL4 protein measurement, may be obtained in a liver or adipose sample from the patient. In some embodiments, the sample comprises intestinal tissue such as small intestinal tissue. In some embodiments, the sample is a small intestine sample. In some embodiments, the sample comprises lymph node tissue such as mesenteric lymph node tissue. In some embodiments, the sample is a mesenteric lymph node sample. In some embodiments, the sample comprises cardiac tissue such as ventricular or atrial tissue. In some embodiments, the sample is a cardiac sample. In some embodiments, the tissue sample comprises liver, adipose, small intestine, mesenteric lymph node, or cardiac tissue. In some embodiments, the tissue sample comprises brown adipose tissue, white adipose tissue, kidney tissue, or muscle tissue.

D. Effects

In some embodiments, the composition or administration of the composition affects a measurement such as a triglyceride measurement, a cholesterol measurement, an HDL measurement, a glucose measurement, an insulin measurement, an ANGPTL4 protein measurement (for example, circulating or tissue ANGPTL4 protein levels), or an ANGPTL4 mRNA measurement, relative to the baseline measurement.

Some embodiments of the methods described herein include obtaining the measurement from a subject. For example, the measurement may be obtained from the subject after treating the subject. In some embodiments, the measurement is obtained in a second sample (such as a fluid or tissue sample described herein) obtained from the subject after the composition is administered to the subject. In some embodiments, the measurement is an indication that the disorder has been treated.

In some embodiments, the measurement is obtained by an assay as described herein. For example, the assay may comprise an immunoassay, a colorimetric assay, a fluorescence assay, or a PCR assay.

In some embodiments, the measurement is obtained within 1 week, within 2 weeks, within 3 weeks, within 1 month, within 2 months, within 3 months, within 6 months, within 1 year, within 2 years, within 3 years, within 4 years, or within 5 years after the administration of the composition. In some embodiments, the measurement is obtained after 1 week, after 2 weeks, after 3 weeks, after 1 month, after 2 months, after 3 months, after 6 months, after 1 year, after 2 years, after 3 years, after 4 years, or after 5 years, following the administration of the composition.

In some embodiments, the measurement is a triglyceride measurement. In some embodiments, the triglyceride measurement is a triglyceride concentration (for example, mg/dL). In some embodiments, the triglyceride measurement is a circulating triglyceride measurement. In some embodiments, the triglyceride measurement is obtained by an assay such as an immunoassay, a colorimetric assay, or a fluorescence assay.

In some embodiments, the composition reduces the triglyceride measurement relative to the baseline triglyceride measurement. In some embodiments, the composition reduces circulating triglycerides relative to the baseline triglyceride measurement. In some embodiments, the reduced triglycerides are measured in a second sample obtained from the subject after administering the composition to the subject.

In some embodiments, the triglyceride measurement is decreased by about 2.5% or more, about 5% or more, or about 7.5% or more, relative to the baseline triglyceride measurement. In some embodiments, the triglyceride measurement is decreased by about 10% or more, relative to the baseline triglyceride measurement. In some embodiments, the triglyceride measurement is decreased by about 20% or more, about 30% or more, about 40% or more, about 50% or more, about 60% or more, about 70% or more, about 80% or more, about 90% or more, or about 100%, relative to the baseline triglyceride measurement. In some embodiments, the triglyceride measurement is decreased by no more than about 2.5%, no more than about 5%, or no more than about 7.5%, relative to the baseline triglyceride measurement. In some embodiments, the triglyceride measurement is decreased by no more than about 10%, relative to the baseline triglyceride measurement. In some embodiments, the triglyceride measurement is decreased by no more than about 20%, no more than about 30%, no more than about 40%, no more than about 50%, no more than about 60%, no more than about 70%, no more than about 80%, no more than about 90%, or no more than about 100% relative to the baseline triglyceride measurement. In some embodiments, the triglyceride measurement is decreased by 2.5%, 5%, 7.5%, 10%, 20%, 30%, 40%, 50%, 60%, 70%, 80%, 90%, 100%, or by a range defined by any of the two aforementioned percentages.

In some embodiments, the measurement is a cholesterol measurement. In some embodiments, the cholesterol measurement is a total cholesterol measurement. In some embodiments, the cholesterol measurement is a cholesterol concentration. In some embodiments, the cholesterol concentration is a total cholesterol concentration. In some embodiments, the cholesterol measurement is a circulating cholesterol measurement. In some embodiments, the cholesterol measurement is a low density lipoprotein (LDL) measurement. In some embodiments, the cholesterol measurement is a very low density lipoprotein (VLDL) measurement. In some embodiments, the cholesterol measurement is obtained by an assay such as an immunoassay, a colorimetric assay, or a fluorescence assay.

In some embodiments, the composition reduces the cholesterol measurement relative to the baseline cholesterol measurement. In some embodiments, the composition reduces circulating cholesterol relative to the baseline cholesterol measurement. In some embodiments, the reduced cholesterol is measured in a second sample obtained from the subject after administering the composition to the subject.

In some embodiments, the cholesterol measurement is decreased by about 2.5% or more, about 5% or more, or about 7.5% or more, relative to the baseline cholesterol measurement. In some embodiments, the cholesterol measurement is decreased by about 10% or more, relative to the baseline cholesterol measurement. In some embodiments, the cholesterol measurement is decreased by about 20% or more, about 30% or more, about 40% or more, about 50% or more, about 60% or more, about 70% or more, about 80% or more, about 90% or more, or about 100%, relative to the baseline cholesterol measurement. In some embodiments, the cholesterol is decreased by no more than about 2.5%, no more than about 5%, or no more than about 7.5%, relative to the baseline cholesterol measurement. In some embodiments, the cholesterol is decreased by no more than about 10%, relative to the baseline cholesterol measurement. In some embodiments, the cholesterol is decreased by no more than about 20%, no more than about 30%, no more than about 40%, no more than about 50%, no more than about 60%, no more than about 70%, no more than about 80%, no more than about 90%, or no more than about 100% relative to the baseline cholesterol measurement. In some embodiments, the cholesterol measurement is decreased by 2.5%, 5%, 7.5%, 10%, 20%, 30%, 40%, 50%, 60%, 70%, 80%, 90%, 100%, or by a range defined by any of the two aforementioned percentages.

In some embodiments, the measurement is an HDL measurement. In some embodiments, the HDL measurement is an HDL concentration. In some embodiments, the HDL measurement is indicated relative to a total cholesterol measurement. In some embodiments, the HDL measurement is a circulating HDL measurement. In some embodiments, the HDL measurement is obtained by an assay such as an immunoassay, a colorimetric assay, or a fluorescence assay.

In some embodiments, the composition reduces the HDL measurement relative to the baseline HDL measurement. In some embodiments, the composition increases circulating HDL relative to the baseline HDL measurement. In some embodiments, the increased HDL is measured in a second sample obtained from the subject after administering the composition to the subject.

In some embodiments, the HDL measurement is increased by about 2.5% or more, about 5% or more, or about 7.5% or more, relative to the baseline HDL measurement. In some embodiments, the HDL measurement is increased by about 10% or more, relative to the baseline HDL measurement. In some embodiments, the HDL measurement is increased by about 20% or more, about 30% or more, about 40% or more, about 50% or more, about 60% or more, about 70% or more, about 80% or more, about 90% or more, or about 100% or more relative to the baseline HDL measurement. In some embodiments, the HDL measurement is increased by about 200% or more, about 300% or more, about 400% or more, about 500% or more, about 600% or more, about 700% or more, about 800% or more, about 900% or more, or about 1000% or more, relative to the baseline HDL measurement. In some embodiments, the HDL measurement is increased by no more than about 2.5%, no more than about 5%, or no more than about 7.5%, relative to the baseline HDL measurement. In some embodiments, the HDL measurement is increased by no more than about 10%, relative to the baseline HDL measurement. In some embodiments, the HDL measurement is increased by no more than about 20%, no more than about 30%, no more than about 40%, no more than about 50%, no more than about 60%, no more than about 70%, no more than about 80%, no more than about 90%, or no more than about 100% relative to the baseline HDL measurement. In some embodiments, the HDL measurement is increased by no more than about 200%, no more than about 300%, no more than about 400%, no more than about 500%, no more than about 600%, no more than about 700%, no more than about 800%, no more than about 900%, or no more than about 1000%, relative to the baseline HDL measurement. In some embodiments, the HDL measurement is increased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the measurement is a glucose measurement. In some embodiments, the glucose measurement comprises a glucose concentration (for example, mg/dL). In some embodiments, the glucose measurement is a glucose concentration. In some embodiments, the glucose measurement is a circulating glucose measurement. In some embodiments, the glucose measurement is obtained by an assay such as an immunoassay, a colorimetric assay, or a fluorescence assay. In some embodiments, the glucose measurement is obtained using a glucometer.

In some embodiments, the glucose measurement comprises a glucose tolerance test. In some embodiments, the glucose tolerance test comprises administering glucose to the subject, and then obtaining multiple glucose measurements over time after administering the glucose to the subject. In some embodiments, the glucose is administered orally. In some embodiments, the glucose is administered by injection. In some embodiments, the multiple glucose measurements are integrated into a glucose area under the curve (AUC) measurement. In some embodiments, the glucose tolerance test is performed on the subject in a fasted state such as after an overnight fast. In some embodiments, the glucose measurement comprises a glucose measurement other than a glucose tolerance test.

In some embodiments, the composition reduces the glucose measurement relative to the baseline glucose measurement. In some embodiments, the composition reduces circulating glucose relative to the baseline glucose measurement. In some embodiments, the reduced glucose is measured in a second sample obtained from the subject after administering the composition to the subject. In some embodiments, the composition reduces one or more of the multiple glucose measurements of the glucose tolerance test relative to one or more of the multiple glucose measurements of the baseline glucose tolerance test. In some embodiments, the composition reduces the glucose AUC measurement relative to the baseline glucose AUC measurement.

In some embodiments, the glucose measurement is decreased by about 2.5% or more, about 5% or more, or about 7.5% or more, relative to the baseline glucose measurement. In some embodiments, the glucose measurement is decreased by about 10% or more, relative to the baseline glucose measurement. In some embodiments, the glucose measurement is decreased by about 20% or more, about 30% or more, about 40% or more, about 50% or more, about 60% or more, about 70% or more, about 80% or more, about 90% or more, or about 100%, relative to the baseline glucose measurement. In some embodiments, the glucose is decreased by no more than about 2.5%, no more than about 5%, or no more than about 7.5%, relative to the baseline glucose measurement. In some embodiments, the glucose is decreased by no more than about 10%, relative to the baseline glucose measurement. In some embodiments, the glucose is decreased by no more than about 20%, no more than about 30%, no more than about 40%, no more than about 50%, no more than about 60%, no more than about 70%, no more than about 80%, no more than about 90%, or no more than about 100% relative to the baseline glucose measurement. In some embodiments, the glucose measurement is decreased by 2.5%, 5%, 7.5%, 10%, 20%, 30%, 40%, 50%, 60%, 70%, 80%, 90%, 100%, or by a range defined by any of the two aforementioned percentages.

In some embodiments, the measurement is an insulin measurement. In some embodiments, the insulin measurement is an insulin sensitivity measurement. In some embodiments, the insulin sensitivity measurement is obtained using a glucose clamp technique such as a hyperinsulinemic euglycemic clamp. In some embodiments, the insulin measurement comprises an insulin concentration. In some embodiments, the insulin measurement is an insulin concentration. In some embodiments, the insulin measurement is a circulating insulin measurement. In some embodiments, the insulin measurement is obtained by an assay such as an immunoassay, a colorimetric assay, or a fluorescence assay.

In some embodiments, the insulin sensitivity measurement comprises a glucose tolerance test. In some embodiments, the insulin sensitivity measurement comprises an insulin sensitivity measurement other than a glucose tolerance test.

In some embodiments, the insulin measurement comprises an insulin response test. In some embodiments, the insulin response test comprises administering glucose to the subject, and then obtaining multiple insulin measurements over time after administering the glucose to the subject. In some embodiments, the glucose is administered orally. In some embodiments, the glucose is administered by injection. In some embodiments, the multiple insulin measurements are integrated into an insulin AUC measurement. In some embodiments, the insulin response test is performed on the subject in a fasted state such as after an overnight fast.

In some embodiments, the insulin measurement comprises a glucose response test. In some embodiments, the glucose response test comprises administering insulin to the subject, and then obtaining multiple glucose measurements over time after administering the insulin to the subject. In some embodiments, the insulin is administered by injection. In some embodiments, the multiple glucose measurements are integrated into a glucose AUC measurement. In some embodiments, the multiple glucose measurements are measured with a glucometer. In some embodiments, the glucose response test is performed on the subject in a fasted state such as after an overnight fast. In some embodiments, the glucose response test is performed on the subject after administering food, drink, or glucose to the subject.

In some embodiments, the composition increases the insulin sensitivity relative to the baseline insulin sensitivity measurement. In some embodiments, the insulin sensitivity is increased by about 2.5% or more, about 5% or more, or about 7.5% or more, relative to the baseline insulin sensitivity measurement. In some embodiments, the insulin sensitivity is increased by about 10% or more, relative to the baseline insulin sensitivity measurement. In some embodiments, the insulin sensitivity is increased by about 20% or more, about 30% or more, about 40% or more, about 50% or more, about 60% or more, about 70% or more, about 80% or more, about 90% or more, or about 100% or more relative to the baseline insulin sensitivity measurement. In some embodiments, the insulin sensitivity is increased by about 200% or more, about 300% or more, about 400% or more, about 500% or more, about 600% or more, about 700% or more, about 800% or more, about 900% or more, or about 1000% or more, relative to the baseline insulin sensitivity measurement. In some embodiments, the insulin sensitivity is increased by no more than about 2.5%, no more than about 5%, or no more than about 7.5%, relative to the baseline insulin sensitivity measurement. In some embodiments, the insulin sensitivity is increased by no more than about 10%, relative to the baseline insulin sensitivity measurement. In some embodiments, the insulin sensitivity is increased by no more than about 20%, no more than about 30%, no more than about 40%, no more than about 50%, no more than about 60%, no more than about 70%, no more than about 80%, no more than about 90%, or no more than about 100% relative to the baseline insulin sensitivity measurement. In some embodiments, the insulin sensitivity is increased by no more than about 200%, no more than about 300%, no more than about 400%, no more than about 500%, no more than about 600%, no more than about 700%, no more than about 800%, no more than about 900%, or no more than about 1000%, relative to the baseline insulin sensitivity measurement. In some embodiments, the insulin sensitivity is increased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the composition reduces the insulin measurement relative to the baseline insulin measurement. In some embodiments, the composition reduces circulating insulin relative to the baseline insulin measurement. In some embodiments, the reduced insulin is measured in a second sample obtained from the subject after administering the composition to the subject. In some embodiments, the composition reduces the insulin AUC measurement relative to the baseline insulin AUC measurement.

In some embodiments, the insulin measurement is decreased by about 2.5% or more, about 5% or more, or about 7.5% or more, relative to the baseline insulin measurement. In some embodiments, the insulin measurement is decreased by about 10% or more, relative to the baseline insulin measurement. In some embodiments, the insulin measurement is decreased by about 20% or more, about 30% or more, about 40% or more, about 50% or more, about 60% or more, about 70% or more, about 80% or more, about 90% or more, or about 100%, relative to the baseline insulin measurement. In some embodiments, the insulin is decreased by no more than about 2.5%, no more than about 5%, or no more than about 7.5%, relative to the baseline insulin measurement. In some embodiments, the insulin is decreased by no more than about 10%, relative to the baseline insulin measurement. In some embodiments, the insulin is decreased by no more than about 20%, no more than about 30%, no more than about 40%, no more than about 50%, no more than about 60%, no more than about 70%, no more than about 80%, no more than about 90%, or no more than about 100% relative to the baseline insulin measurement. In some embodiments, the insulin measurement is decreased by 2.5%, 5%, 7.5%, 19%, 20%, 30%, 40%, 50%, 60%, 70%, 80%, 90%, 100%, or by a range defined by any of the two aforementioned percentages.

In some embodiments, the measurement is an ANGPTL4 protein measurement. In some embodiments, the ANGPTL4 protein measurement comprises an ANGPTL4 protein level. In some embodiments, the ANGPTL4 protein level is indicated as a mass or percentage of ANGPTL4 protein per sample weight. In some embodiments, the ANGPTL4 protein level is indicated as a mass or percentage of ANGPTL4 protein per sample volume. In some embodiments, the ANGPTL4 protein level is indicated as a mass or percentage of ANGPTL4 protein per total protein within the sample. In some embodiments, the ANGPTL4 protein measurement is a cell (e.g. hepatocyte) ANGPTL4 protein measurement. In some embodiments, the ANGPTL4 protein measurement is a tissue (e.g. liver tissue) ANGPTL4 protein measurement. In some embodiments, the ANGPTL4 protein measurement is a circulating ANGPTL4 protein measurement. In some embodiments, the baseline ANGPTL4 protein measurement is obtained by an assay such as an immunoassay, a colorimetric assay, or a fluorescence assay.

In some embodiments, the composition reduces the ANGPTL4 protein measurement relative to the baseline ANGPTL4 protein measurement. In some embodiments, the composition reduces circulating ANGPTL4 protein levels relative to the baseline ANGPTL4 protein measurement. In some embodiments, the composition reduces tissue ANGPTL4 protein levels (such as liver tissue ANGPTL protein levels) relative to the baseline ANGPTL4 protein measurement. In some embodiments, the composition reduces cell ANGPTL4 protein levels (such as hepatocyte ANGPTL protein levels) relative to the baseline ANGPTL4 protein measurement. In some embodiments, the reduced ANGPTL4 protein levels are measured in a second sample obtained from the subject after administering the composition to the subject.

In some embodiments, the ANGPTL4 protein measurement is decreased by about 2.5% or more, about 5% or more, or about 7.5% or more, relative to the baseline ANGPTL4 protein measurement. In some embodiments, the ANGPTL4 protein measurement is decreased by about 10% or more, relative to the baseline ANGPTL4 protein measurement. In some embodiments, the ANGPTL4 protein measurement is decreased by about 20% or more, about 30% or more, about 40% or more, about 50% or more, about 60% or more, about 70% or more, about 80% or more, about 90% or more, or about 100%, relative to the baseline ANGPTL4 protein measurement. In some embodiments, the ANGPTL4 protein measurement is decreased by no more than about 2.5%, no more than about 5%, or no more than about 7.5%, relative to the baseline ANGPTL4 protein measurement. In some embodiments, the ANGPTL4 protein measurement is decreased by no more than about 10%, relative to the baseline ANGPTL4 protein measurement. In some embodiments, the ANGPTL4 protein measurement is decreased by no more than about 20%, no more than about 30%, no more than about 40%, no more than about 50%, no more than about 60%, no more than about 70%, no more than about 80%, no more than about 90%, or no more than about 100% relative to the baseline ANGPTL4 protein measurement. In some embodiments, the ANGPTL4 protein measurement is decreased by 2.5%, 5%, 7.5%, 19%, 20%, 30%, 40%, 50%, 60%, 70%, 80%, 90%, 100%, or by a range defined by any of the two aforementioned percentages.

In some embodiments, the measurement is an ANGPTL4 mRNA measurement. In some embodiments, the ANGPTL4 mRNA measurement comprises an ANGPTL4 mRNA level. In some embodiments, the ANGPTL4 mRNA level is indicated as a mass or percentage of ANGPTL4 mRNA per sample weight. In some embodiments, the ANGPTL4 mRNA level is indicated as a mass or percentage of ANGPTL4 mRNA per sample volume. In some embodiments, the ANGPTL4 mRNA level is indicated as a mass or percentage of ANGPTL4 mRNA per total mRNA within the sample. In some embodiments, the ANGPTL4 mRNA level is indicated as a mass or percentage of ANGPTL4 mRNA per total nucleic acids within the sample. In some embodiments, the ANGPTL4 mRNA level is indicated relative to another mRNA level, such as an mRNA level of a housekeeping gene, within the sample. In some embodiments, the ANGPTL4 mRNA measurement is obtained by an assay such as a PCR assay. In some embodiments, the PCR comprises qPCR. In some embodiments, the PCR comprises reverse transcription of the ANGPTL4 mRNA.

In some embodiments, the composition reduces the ANGPTL4 mRNA measurement relative to the baseline ANGPTL4 mRNA measurement. In some embodiments, the ANGPTL4 mRNA measurement is obtained in a second sample obtained from the subject after administering the composition to the subject. In some embodiments, the composition reduces ANGPTL4 mRNA levels relative to the baseline ANGPTL4 mRNA levels. In some embodiments, the reduced ANGPTL4 mRNA levels are measured in a second sample obtained from the subject after administering the composition to the subject. In some embodiments, the second sample is a liver sample. In some embodiments, the second sample is an adipose sample.

In some embodiments, the ANGPTL4 mRNA measurement is reduced by about 2.5% or more, about 5% or more, or about 7.5% or more, relative to the baseline ANGPTL4 mRNA measurement. In some embodiments, the ANGPTL4 mRNA measurement is decreased by about 10% or more, relative to the baseline ANGPTL4 mRNA measurement. In some embodiments, the ANGPTL4 mRNA measurement is decreased by about 20% or more, about 30% or more, about 40% or more, about 50% or more, about 60% or more, about 70% or more, about 80% or more, about 90% or more, or about 100%, relative to the baseline ANGPTL4 mRNA measurement. In some embodiments, the ANGPTL4 mRNA measurement is decreased by no more than about 2.5%, no more than about 5%, or no more than about 7.5%, relative to the baseline ANGPTL4 mRNA measurement. In some embodiments, the ANGPTL4 mRNA measurement is decreased by no more than about 10%, relative to the baseline ANGPTL4 mRNA measurement. In some embodiments, the ANGPTL4 mRNA measurement is decreased by no more than about 20%, no more than about 30%, no more than about 40%, no more than about 50%, no more than about 60%, no more than about 70%, no more than about 80%, no more than about 90%, or no more than about 100% relative to the baseline ANGPTL4 mRNA measurement. In some embodiments, the ANGPTL4 mRNA measurement is decreased by 2.5%, 5%, 7.5%, 10%, 20%, 30%, 40%, 50%, 60%, 70%, 80%, 90%, 100%, or by a range defined by any of the two aforementioned percentages.

III. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

Throughout this application, various embodiments may be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used in the specification and claims, the singular forms "a", "an" and "the" include plural references unless the context clearly dictates otherwise. For example, the term "a sample" includes a plurality of samples, including mixtures thereof.

The terms "determining," "measuring," "evaluating," "assessing," "assaying," and "analyzing" are often used interchangeably herein to refer to forms of measurement. The terms include determining if an element is present or not (for example, detection). These terms can include quantitative, qualitative or quantitative and qualitative determinations. Assessing can be relative or absolute. "Detecting the presence of" can include determining the amount of something present in addition to determining whether it is present or absent depending on the context.

The terms "subject," and "patient" may be used interchangeably herein. A "subject" can be a biological entity containing expressed genetic materials. The biological entity can be a plant, animal, or microorganism, including, for example, bacteria, viruses, fungi, and protozoa. The subject can be a mammal. The mammal can be a human. The subject may be diagnosed or suspected of being at high risk for a disease. In some cases, the subject is not necessarily diagnosed or suspected of being at high risk for the disease.

As used herein, the term "about" a number refers to that number plus or minus 10% of that number. The term "about" a range refers to that range minus 10% of its lowest value and plus 10% of its greatest value.

As used herein, the terms "treatment" or "treating" are used in reference to a pharmaceutical or other intervention regimen for obtaining beneficial or desired results in the recipient. Beneficial or desired results include but are not limited to a therapeutic benefit and/or a prophylactic benefit. A therapeutic benefit may refer to eradication or amelioration of symptoms or of an underlying disorder being treated. Also, a therapeutic benefit can be achieved with the eradication or amelioration of one or more of the physiological symptoms associated with the underlying disorder such that an improvement is observed in the subject, notwithstanding that the subject may still be afflicted with the underlying disorder. A prophylactic effect includes delaying, preventing, or eliminating the appearance of a disease or condition, delaying or eliminating the onset of symptoms of a disease or condition, slowing, halting, or reversing the progression of a disease or condition, or any combination thereof. For prophylactic benefit, a subject at risk of developing a particular disease, or to a subject reporting one or more of the physiological symptoms of a disease may undergo treatment, even though a diagnosis of this disease may not have been made.

The section headings used herein are for organizational purposes only and are not to be construed as limiting the subject matter described.

IV. Sequence Information

Some embodiments include one or more nucleic acid sequences in the following table:

TABLE 1

| SEQ ID NO: | Description |
|---|---|
| 1-1854 & 13970-13977 | ANGPTL4 siRNA oligonucleotide sense strand sequences |
| 1855-3708 & 13978-13985 | ANGPTL4 siRNA oligonucleotide antisense strand sequences |
| 3709-13934 | ANGPTL4 ASO sequences |
| 13935 | Full-length human ANGPTL4 human mRNA sequence (GenBank Acc.# NM_139314.3) |
| 13936 | Full-length ANGPTL4 human pre-mRNA sequence (NC_00019.10: 8364129-8374373) |
| 13937-13944 | Sequences for siRNA sense strands targeting mouse ANGPTL4 |
| 13945-13952 | Sequences for siRNA antisense strands targeting mouse ANGPTL4 |
| 13953 | Non-targeting control ASO oligonucleotide sequence |
| 13954-13959 | Modification pattern 1S to 6S |
| 13960-13968 | Modification pattern 1AS to 9AS |
| 13969 | Modification pattern ASO1 |

TABLE 1-continued

| SEQ ID NO: | Description |
|---|---|
| 13986-14133 | Modified ANGPTL4 siRNA oligonucleotide sense strand sequences |
| 14134-14288 | Modified ANGPTL4 siRNA oligonucleotide antisense strand sequences |
| 14289-14290 | ETD00971 sense and antisense strands |
| 14291-14292 | ETD00959 sense and antisense strands |

V. Embodiments

Some embodiments include one or more of the following:

1. A composition comprising an oligonucleotide that targets Angiopoietin-like 4 (ANGPTL4) and when administered to a subject in an effective amount decreases circulating triglycerides.

2. The composition of embodiment 1, wherein the triglycerides are decreased by about 10% or more, as compared to prior to administration.

3. A composition comprising an oligonucleotide that targets ANGPTL4 and when administered to a subject in an effective amount decreases circulating total cholesterol.

4. The composition of embodiment 3, wherein the total cholesterol is decreased by about 10% or more, as compared to prior to administration.

5. A composition comprising an oligonucleotide that targets ANGPTL4 and when administered to a subject in an effective amount increases circulating high-density lipoproteins (HDL).

6. The composition of embodiment 5, wherein the HDL are increased by about 10% or more, as compared to prior to administration.

7. A composition comprising an oligonucleotide that targets ANGPTL4 and when administered to a subject in an effective amount decreases circulating glucose.

8. The composition of embodiment 7, wherein the glucose is decreased by about 10% or more, as compared to prior to administration.

9. A composition comprising an oligonucleotide that targets ANGPTL4 and when administered to a subject in an effective amount increases insulin sensitivity.

10. The composition of embodiment 9, wherein the insulin sensitivity is increased by about 10% or more, as compared to prior to administration.

11. The composition of any one of embodiments 1-10, wherein the oligonucleotide comprises a modified internucleoside linkage.

12. The composition of embodiment 11, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

13. The composition of embodiment 11, wherein the modified internucleoside linkage comprises one or more phosphorothioate linkages.

14. The composition of any one of embodiments 1-13, wherein the oligonucleotide comprises 1, 2, 3, 4, 5, 6, 7, 8, 9, 10, 11, 12, 13, 14, 15, 16, 17, 18, 19, or 20 modified internucleoside linkages.

15. The composition of any one of embodiments 1-14, wherein the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

16. The composition of any one of embodiments 1-15, wherein the oligonucleotide comprises a modified nucleoside.

17. The composition of embodiment 16, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

18. The composition of embodiment 16, wherein the modified nucleoside comprises a LNA.

19. The composition of embodiment 16, wherein the modified nucleoside comprises a 2',4' constrained ethyl nucleic acid.

20. The composition of embodiment 16, wherein the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

21. The composition of embodiment 16, wherein the modified nucleoside comprises one or more 2'fluoro modified nucleosides.

22. The composition of embodiment 16, wherein the modified nucleoside comprises a 2' O-alkyl modified nucleoside.

23. The composition of embodiment 16, wherein the oligonucleotide comprises a lipid attached at a 3' or 5' terminus of the oligonucleotide.

24. The composition of embodiment 23, wherein the lipid comprises cholesterol, myristoyl, palmitoyl, stearoyl, lithocholoyl, docosanoyl, docosahexaenoyl, myristyl, palmityl stearyl, or α-tocopherol, or a combination thereof.

25. The composition of any one of embodiments 1-24, wherein the oligonucleotide comprises 1, 2, 3, 4, 5, 6, 7, 8, 9, 10, 11, 12, 13, 14, 15, 16, 17, 18, 19, 20, or 21 modified nucleosides.

26. The composition of any one of embodiments 1-25, wherein the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

27. The composition of any one of embodiments 1-26, wherein the oligonucleotide comprises an N-acetylgalactosamine (GalNAc) ligand for hepatocyte targeting.

28. The composition of any one of embodiments 1-27, wherein the oligonucleotide comprises a small interfering RNA (siRNA) comprising a sense strand and an antisense strand.

29. The composition of embodiment 28, wherein the sense strand is 14-30 nucleosides in length.

30. The composition of embodiment 28 or 29, wherein the antisense strand is 14-30 nucleosides in length.

31. A composition comprising an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13935.

32. A composition comprising an oligonucleotide that inhibits the expression of ANGPTL4, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13936.

33. The composition of any one of embodiments 28-32, wherein the sense strand and the antisense strand form a double-stranded RNA duplex.

34. The composition of embodiment 33, wherein the first base pair of the double-stranded RNA duplex is an AU base pair.

35. The composition of any one of embodiments 28-34, wherein the sense strand comprises a 3' overhang comprising 1, 2, or more nucleosides.

36. The composition of embodiment 35, wherein the 3' overhang of the sense strand comprises 2 nucleosides.

37. The composition of any one of embodiments 28-36, wherein the antisense strand comprises a 3' overhang comprising 1, 2, or more nucleosides.

38. The composition of embodiment 37, wherein the 3' overhang of the antisense strand comprises 2 nucleosides.

39. The composition of any one of embodiments 28-38, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions.

40. The composition of any one of embodiments 28-39, wherein the sense strand comprises a nucleoside sequence comprising or consisting of the sequence of any one of SEQ ID NOs: 1-1854 or 13970-13977.

41. The composition of any one of embodiments 28-40, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions.

42. The composition of any one of embodiments 28-41, wherein the antisense strand comprises a nucleoside sequence comprising or consisting of the sequence of any one of SEQ ID NOs: 1855-3708 or 13978-13985.

43. The composition of any one of embodiments 28-42, wherein the siRNA binds with a 17mer in a non-human primate ANGPTL4 mRNA.

44. The composition of any one of embodiments 28-43, wherein the siRNA binds with a 19mer in a human ANGPTL4 mRNA.

45. The composition of any one of embodiments 28-44, wherein the siRNA binds with a human ANGPTL4 mRNA and less than or equal to 20 human off-targets, with no more than 2 mismatches in the antisense strand.

46. The composition of any one of embodiments 28-45, wherein the siRNA binds with a human ANGPTL4 mRNA target site that does not harbor an SNP, with a minor allele frequency (MAF) greater or equal to 1% (pos. 2-18).

47. The composition of any one of embodiments 28-46, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside substitutions, additions, or deletions; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside substitutions, additions, or deletions.

48. The composition of any one of embodiments 28-47, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657.

49. The composition of any one of embodiments 28-48, wherein the sense strand comprises the nucleoside sequence of any one of SEQ ID NOs: 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, or 1787; and wherein the antisense strand comprises the nucleoside sequence of any one of SEQ ID NOs: 1887, 1888, 1889, 1890, 1910, 1975, 2126, 2134, 2136, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2335, 2338, 2363, 2371, 2373, 2374, 2419, 2474, 2489, 2491, 2494, 2684, 2688, 2695, 2696, 2697, 2698, 2704, 2725, 2726, 2730, 2741, 2742, 2748, 2751, 2756, 2799, 2855, 2856, 2859, 2891, 2987, 2988, 2991, 3003, 3005, 3007, 3008, 3009, 3011, 3012, 3015, 3016, 3018, 3019, 3020, 3025, 3026, 3102, 3103, 3169, 3192, 3197, 3201, 3202, 3283, 3284, 3424, 3425, 3426, 3464, 3465, 3471, 3634, 3638, or 3641.

50. The composition of any one of embodiments 28-49, wherein the sense strand comprises the nucleoside sequence of any one of SEQ ID NOs: 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, or 1803; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1966, 1970, 1971, 1972, 1973, 1974, 1979, 1980, 1981, 1982, 1983, 2003, 2004, 2006, 2007, 2011, 2012, 2013, 2015, 2018, 2019, 2020, 2021, 2022, 2023, 2026, 2028, 2029, 2050, 2053, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2234, 2236, 2240, 2242, 2245, 2246, 2247, 2248, 2251, 2252, 2253, 2256, 2258, 2259, 2265, 2266, 2267, 2268, 2269, 2274, 2275, 2276, 2277, 2278, 2279, 2280, 2281, 2282, 2283, 2284, 2285, 2289, 2338, 2371, 2373, 2374, 2419, 2424, 2425, 2426, 2461, 2462, 2464, 2465, 2466, 2470, 2471, 2474, 2489, 2491, 2494, 2526, 2527, 2528, 2529, 2530, 2531, 2532, 2533, 2535, 2536, 2537, 2538, 2540, 2541, 2543, 2546, 2549, 2684, 2695, 2696, 2697, 2698, 2704, 2705, 2706, 2707, 2708, 2710, 2711, 2720, 2722, 2725, 2726, 2730, 2741, 2742, 2744, 2746, 2747, 2748, 2756, 2765, 2766, 2767, 2768, 2769, 2770, 2771, 2772, 2773, 2774, 2775, 2776, 2799, 2855, 2856, 2859, 2860, 2863, 2864, 2865, 2867, 2882, 2886, 2906, 2907, 2908, 2909, 2911, 2912, 2966, 2976, 2978, 2980, 2981, 2987, 2988, 3001, 3002, 3003, 3005, 3007, 3008, 3009, 3011, 3012, 3015, 3016, 3018, 3019, 3020, 3029, 3036, 3038, 3106, 3107, 3113, 3130, 3139, 3164, 3169, 3197, 3201, 3202, 3203, 3204, 3205, 3259, 3261, 3267, 3268, 3269, 3270, 3271, 3272, 3283, 3284, 3302, 3373, 3377, 3410, 3415, 3417, 3418, 3419, 3425, 3426, 3434, 3435, 3443, 3451, 3455, 3456, 3457, 3458, 3459, 3460, 3465, 3467, 3468, 3547, 3553, 3555, 3556, 3557, 3576, 3594, 3595, 3596, 3599, 3601, 3602, 3603, 3605, 3608, 3609, 3633, 3634, 3638, 3642, 3652, 3653, 3655, 3656, or 3657.

51. The composition of any one of embodiments 28-50, wherein the sense strand comprises the nucleoside sequence of any one of SEQ ID NOs: 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, or 1784; and wherein the antisense strand comprises the nucleoside sequence of any one of SEQ ID NOs: 1887, 1888, 1889, 1890, 1910, 2126, 2134, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2338, 2371, 2373, 2374, 2419, 2474, 2489, 2491, 2494, 2684, 2695, 2696, 2697, 2698, 2704, 2725, 2726, 2730, 2741, 2742, 2748, 2756, 2799, 2855, 2856, 2859, 2987, 2988, 3003, 3005, 3007, 3008, 3009, 3011, 3012, 3015, 3016, 3018, 3019, 3020, 3169, 3197, 3201, 3202, 3283, 3284, 3425, 3426, 3465, 3634, or 3638.

52. The composition of any one of embodiments 28-51, wherein the antisense strand comprises a seed region that is not identical to a seed region of a human miRNA.

53. The composition of any one of embodiments 28-52, wherein the sense strand comprises the nucleoside sequence of any one of SEQ ID NOs: 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, or 1803, or 3638; and wherein the antisense strand comprises the nucleoside sequence of any one of SEQ ID NOs: 1886, 1890, 1910, 1911, 1912, 1915, 1916, 1933, 1934, 1971, 1973, 1979, 1980, 1982, 2003, 2006, 2011, 2012, 2013, 2015, 2019, 2020, 2021, 2022, 2023, 2028, 2050, 2065, 2066, 2071, 2072, 2073, 2084, 2085, 2099, 2100, 2107, 2114, 2115, 2116, 2125, 2126, 2134, 2143, 2145, 2146, 2147, 2158, 2175, 2177, 2179, 2180, 2182, 2184, 2185, 2186, 2187, 2188, 2191, 2192, 2196, 2201, 2203, 2206, 2207, 2210, 2234, 2236, 2240, 2242, 2245, 2246, 2248, 2253, 2267, 2268, 2269, 2276, 2277, 2278, 2279, 2280, 2289, 2371, 2373, 2374, 2419, 2425, 2461, 2462, 2466, 2471, 2474, 2489, 2494, 2526, 2527, 2528, 2529, 2532, 2533, 2535, 2537, 2538, 2541, 2546, 2696, 2697, 2704, 2705, 2708, 2720, 2722, 2730, 2746, 2747, 2756, 2765, 2766, 2767, 2768, 2770, 2773, 2799, 2855, 2856, 2860, 2864, 2882, 2906, 2907, 2908, 2909, 2911, 2966, 2978, 2981, 3001, 3003, 3005, 3007, 3009, 3011, 3018, 3029, 3036, 3038, 3113, 3130, 3139, 3169, 3197, 3203, 3204, 3205, 3259, 3261, 3267, 3269, 3272, 3418, 3425, 3435, 3443, 3451, 3455, 3456, 3457, 3458, 3459, 3460, 3467, 3468, 3547, 3555, 3576, 3594, 3599, 3605, 3609, 3655, 3656, or 3657.

54. The composition of any one of embodiments 28-53, wherein the sense strand comprises the nucleoside sequence of any one of SEQ ID 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, or 1571; and wherein the antisense strand comprises the nucleoside sequence of any one of SEQ ID 1890, 1910, 2126, 2134, 2143, 2145, 2146, 2147, 2175, 2177, 2180, 2182, 2184, 2185, 2186, 2187, 2188, 2191, 2192, 2196, 2201, 2203, 2289, 2371, 2373, 2374, 2419, 2474, 2489, 2494, 2696, 2697, 2704, 2730, 2756, 2799, 2855, 2856, 3003, 3005, 3007, 3009, 3011, 3018, 3169, 3197, or 3425.

55. The composition of any one of embodiments 28-54, wherein the sense strand comprises a seed region that is not identical to a seed region of a human miRNA.

56. The composition of any one of embodiments 28-55, wherein the sense strand comprises the nucleoside sequence of any one of SEQ ID NOs: 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, or 1787; and wherein the antisense strand comprises the nucleoside sequence of any one of SEQ ID NOs: 1886, 1890, 1910, 1912, 1915, 1916, 1934, 1971, 1973, 1980, 2006, 2008, 2011, 2012, 2013, 2015, 2020, 2023, 2028, 2031, 2050, 2065, 2066, 2071, 2072, 2084, 2085, 2099, 2107, 2114, 2115, 2125, 2126, 2134, 2143, 2147, 2158, 2182, 2184, 2185, 2186, 2187, 2188, 2191, 2196, 2201, 2203, 2207, 2210, 2240, 2242, 2245, 2246, 2248, 2268, 2269, 2276, 2277, 2278, 2280, 2289, 2374, 2425, 2462, 2466, 2471, 2507, 2526, 2532, 2533, 2535, 2537, 2546, 2696, 2697, 2705, 2708, 2713, 2730, 2746, 2754, 2767, 2768, 2773, 2822, 2855, 2856, 2908, 2911, 2918, 2966, 2978, 3011, 3018, 3036, 3038, 3102, 3113, 3197, 3205, 3206, 3269, 3272, 3418, 3435, 3456, 3468, 3547, 3555, 3576, 3594, 3605, 3609, or 3641.

57. The composition of any one of embodiments 28-56, wherein the sense strand comprises the nucleoside sequence of any one of SEQ ID NOs: 36, 56, 272, 280, 289, 293, 328, 330, 331, 332, 333, 334, 337, 342, 347, 349, 435, 520, 842, 843, 876, 1001, 1002, 1157, 1164, or 1343; and wherein the antisense strand comprises the nucleoside sequence of any one of SEQ ID NOs: 1890, 1910, 2126, 2134, 2143, 2147, 2182, 2184, 2185, 2186, 2187, 2188, 2191, 2196, 2201, 2203, 2289, 2374, 2696, 2697, 2730, 2855, 2856, 3011, 3018, or 3197.

58. The composition of any one of embodiments 28-57, wherein the sense strand comprises modification pattern 1S: 5'-NfsnsNfnNfnNfNfNfnNfnNfnNfnNfnNfsnsn-3', wherein "Nf" is a 2' fluoro-modified nucleoside, "n" is a 2' O-methyl modified nucleoside, and "s" is a phosphorothioate linkage.

59. The composition of any one of embodiments 28-57, wherein the sense strand comprises modification pattern 2S: 5'-nsnsnnNfnNfNfNfnnnnnnnnnnnsnsn-3', wherein "Nf" is a 2' fluoro-modified nucleoside, "n" is a 2' O-methyl modified nucleoside, and "s" is a phosphorothioate linkage.

60. The composition of any one of embodiments 28-57, wherein the sense strand comprises modification pattern 3S: 5'-nsnsnnNfnNfnNfnNfnnnnnnnnnnnsnsn-3', wherein "Nf" is a 2' fluoro-modified nucleoside, "n" is a 2' O-methyl modified nucleoside, and "s" is a phosphorothioate linkage.

61. The composition of any one of embodiments 28-57, wherein the sense strand comprises modification pattern 4S: 5'-NfsnsNfnNfnNfnNfNfnNfnNfnNfnNfnNfsnsnN-3', wherein "Nf" is a 2' fluoro-modified nucleoside, "n" is a 2' O-methyl modified nucleoside, "s" is a phosphorothioate linkage, and N comprises one or more nucleosides.

62. The composition of any one of embodiments 28-57, wherein the sense strand comprises modification pattern 5S: 5'-nsnsnnNfnNfNfNfnnnnnnnnnnsnsnN-3', wherein "Nf" is a 2' fluoro-modified nucleoside, "n" is a 2' O-methyl modified nucleoside, "s" is a phosphorothioate linkage, and N comprises one or more nucleosides.

63. The composition of any one of embodiments 28-62, wherein the antisense strand comprises modification pattern 1AS: 5'-nsNfsnNfnNfnNfnNfnnnNfnNfnNfsnsn-3', wherein "Nf" is a 2' fluoro-modified nucleoside, "n" is a 2' O-methyl modified nucleoside, and "s" is a phosphorothioate linkage.

64. The composition of any one of embodiments 28-62, wherein the antisense strand comprises modification pattern 2AS: 5'-nsNfsnnnNfnNfNfnnnnNfnNfnnnsnsn-3', wherein "Nf" is a 2' fluoro-modified nucleoside, "n" is a 2' O-methyl modified nucleoside, and "s" is a phosphorothioate linkage.

65. The composition of any one of embodiments 28-62, wherein the antisense strand comprises modification pattern 3AS: 5'-nsNfsnnnNfnnnnnnnNfnNfnnnsnsn-3', wherein "Nf" is a 2' fluoro-modified nucleoside, "n" is a 2' O-methyl modified nucleoside, and "s" is a phosphorothioate linkage.

66. The composition of any one of embodiments 28-62, wherein the antisense strand comprises modification pattern 4AS: 5'-nsNfsnNfnNfnnnnnnnNfnNfnnnsnsn-3', wherein "Nf" is a 2' fluoro-modified nucleoside, "n" is a 2' O-methyl modified nucleoside, and "s" is a phosphorothioate linkage.

67. The composition of any one of embodiments 28-57, wherein the sense strand comprises modification pattern 1S and the antisense strand comprises modification pattern 1AS, 2AS, 3AS, or 4AS.

68. The composition of any one of embodiments 28-57, wherein the sense strand comprises modification pattern 2S and the antisense strand comprises modification pattern 1AS, 2AS, 3AS, or 4AS.

69. The composition of any one of embodiments 28-57, wherein the sense strand comprises modification pattern 3S and the antisense strand comprises modification pattern 1AS, 2AS, 3AS, or 4AS.

70. The composition of any one of embodiments 28-57, wherein the sense strand comprises modification pattern 4S and the antisense strand comprises modification pattern 1AS, 2AS, 3AS, or 4AS.

71. The composition of any one of embodiments 28-57, wherein the sense strand comprises a nucleoside sequence comprising or consisting of the sequence of any one of SEQ ID NOs: 1-1854 or 13970-13977, a nucleic acid sequence thereof having 1 or 2 nucleoside substitutions, additions, or deletions, and modification pattern 1S.

72. The composition of any one of embodiments 28-57, wherein the sense strand comprises a nucleoside sequence comprising or consisting of the sequence of any one of SEQ ID NOs: 1-1854 or 13970-13977, and modification pattern 1S.

73. The composition of any one of embodiments 28-57, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2S.

74. The composition of any one of embodiments 28-57, wherein the sense strand comprises a nucleoside sequence comprising or consisting of the sequence of any one of SEQ ID NOs: 1-1854 or 13970-13977, and modification pattern 2S.

75. The composition of any one of embodiments 28-57 or 71-74, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 1AS.

76. The composition of any one of embodiments 28-57 or 71-74, wherein the antisense strand comprises a nucleoside sequence comprising or consisting of the sequence of any one of SEQ ID NOs: 1855-3708 or 13978-13985, and modification pattern 1AS.

77. The composition of any one of embodiments 28-57 or 71-74, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 3AS.

78. The composition of any one of embodiments 28-57 or 71-74, wherein the antisense strand comprises a nucleoside sequence comprising or consisting of the sequence of any one of SEQ ID NOs: 1855-3708 or 13978-13985, and modification pattern 3AS.

79. The composition of any one of embodiments 1-27, wherein the oligonucleotide comprises an antisense oligonucleotide (ASO).

80. The composition of embodiment 79, wherein the ASO is 12-30 nucleosides in length.

81. A composition comprising an oligonucleotide that inhibits the expression of ANGPTL4, wherein the oligonucleotide comprises an ASO about 12-30 nucleosides in length and comprising a nucleoside sequence complementary to about 12-30 contiguous nucleosides of SEQ ID NO: 13935.

82. A composition comprising an oligonucleotide that inhibits the expression of ANGPTL4, wherein the oligonucleotide comprises an ASO about 12-30 nucleosides in length and comprising a nucleoside sequence complementary to about 12-30 contiguous nucleosides of SEQ ID NO: 13936.

83. The composition of any one of embodiments 79-82, wherein the ASO is 15-25 nucleosides in length.

84. The composition of any one of embodiments 79-83, wherein the ASO is 20 nucleosides in length.

85. The composition of any one of embodiments 79-84, wherein the ASO comprises a nucleoside sequence comprising or consisting of the sequence of any one of SEQ ID NOs: 3709-13934, or a nucleic acid sequence thereof having 1 or 2 nucleoside substitutions, additions, or deletions.

86. The composition of any one of embodiments 79-85, wherein the ASO comprises a nucleoside sequence comprising or consisting of the sequence of any one of SEQ ID NOs: 3709-13934.

87. The composition of any one of embodiments 79-86, wherein the ASO comprises modification pattern: 5'-nsnsns-nsnsdNsdNsdNsdNsdNsdNsdNsdNsdNsnsnsnsnsn-3' where "dN" is any deoxynucleotide, "n" is a 2'O-methyl or 2'O-methoxyethyl-modified nucleoside, and "s" is a phosphorothioate linkage.

88. The composition of any one of embodiments 79-86, wherein the ASO comprises a nucleoside sequence comprising or consisting of the sequence of any one of SEQ ID NOs: 3709-13934, or a nucleic acid sequence thereof having 1 or 2 nucleoside substitutions, additions, or deletions, and modification pattern ASO1.

89. The composition of any one of embodiments 79-86, wherein the ASO comprises a nucleoside sequence comprising or consisting of the sequence of any one of SEQ ID NOs: 3709-13934, and modification pattern ASO1.

90. The composition of any one of embodiments 1-89, wherein the composition is a pharmaceutical composition.

91. The composition of any one of embodiments 1-90, wherein the composition is sterile. 92. The composition of any one of embodiments 1-91, further comprising a pharmaceutically acceptable carrier.

93. The composition of embodiment 92, wherein the pharmaceutically acceptable carrier comprises water, a buffer, or a saline solution.

94. Use of a composition comprising an oligonucleotide that targets ANGPTL4 in a method of treating a metabolic disorder in a subject in need thereof, the method comprising administering to the subject the composition.

95. The use of embodiment 94, wherein the metabolic disorder comprises hyperlipidemia.

96. The use of embodiment 94, wherein the metabolic disorder comprises hypertriglyceridemia.

97. The use of embodiment 94, wherein the metabolic disorder comprises diabetes.

98. The use of embodiment 94, wherein the metabolic disorder comprises type 2 diabetes.

99. Use of a composition comprising an oligonucleotide that targets ANGPTL4 in a method of treating a cardiovascular disorder in a subject in need thereof, the method comprising administering to the subject the composition.

100. The use of embodiment 99, wherein the cardiovascular disorder comprises heart disease.

101. The use of embodiment 99, wherein the cardiovascular disorder comprises myocardial infarction.

102. The use of embodiment 99, wherein the cardiovascular disorder comprises angina pectoris.

103. The use of embodiment 99, wherein the cardiovascular disorder comprises atherosclerosis.

104. The use of any one of embodiments 94-103, wherein the subject is an animal, a mammal, a dog, a cat, cattle, a rodent, a mouse, a rat, a primate, or a monkey.

105. The use of any one of embodiments 94-104, wherein the subject is a human.

106. The use of any one of embodiments 94-105, wherein the subject is ≥40 years of age.

107. The use of any one of embodiments 94-105, wherein the subject is ≤85 years of age.

108. The use of any one of embodiments 94-105, wherein the subject is ≥40 and ≤85 years of age.

109. The use of any one of embodiments 94-109, wherein a baseline measurement is obtained in a sample obtained from the subject prior to administering the composition to the subject.

110. The use of embodiment 109, wherein the sample is obtained from the subject after an overnight fasting period.

111. The use of embodiment 109, wherein the sample is obtained from the subject in a fed state.

112. The use of one of embodiments 109-111, wherein the baseline measurement is obtained by an immunoassay, a colorimetric assay, or a fluorescence assay.

113. The use of any one of embodiments 109-112, wherein the sample is a blood, plasma, or serum sample.

114. The use of one of embodiments 109-113, wherein the sample is a serum sample. 115. The use of any one of embodiments 109-114, wherein the baseline measurement is a baseline triglyceride measurement.

116. The use of any one of embodiments 109-114, wherein the baseline measurement is a baseline cholesterol measurement.

117. The use of any one of embodiments 109-114, wherein the baseline measurement is a baseline HDL measurement.

118. The use of any one of embodiments 109-114, wherein the baseline measurement is a baseline glucose measurement.

119. The use of any one of embodiments 109-114, wherein the baseline measurement is a baseline insulin sensitivity measurement.

120. The use of any one of embodiments 109-112, wherein the sample is a tissue sample.

121. The use of embodiment 120, wherein the tissue sample comprises liver, adipose, small intestine, mesenteric lymph node, or cardiac tissue.

122. The use of embodiment 120 or 121, wherein the tissue sample is a liver sample.

123. The use of any one of embodiments 109-122, wherein the baseline measurement is a baseline ANGPTL4 protein measurement.

124. The use of any one of embodiments 109-122, wherein the baseline measurement is a baseline ANGPTL4 mRNA measurement.

125. The use of embodiment 124, wherein the baseline measurement is obtained by PCR.

126. The use of embodiment 115, wherein the composition reduces circulating triglycerides relative to the baseline triglyceride measurement.

127. The use of embodiment 126, wherein the reduced triglycerides are measured in a second sample obtained from the subject after administering the composition to the subject.

128. The use of embodiment 116, wherein the composition reduces circulating cholesterol relative to the baseline cholesterol measurement.

129. The use of embodiment 128, wherein the reduced cholesterol is measured in a second sample obtained from the subject after administering the composition to the subject.

130. The use of embodiment 117, wherein the composition increases circulating HDL relative to the baseline HDL measurement.

131. The use of embodiment 130, wherein the increased HDL is measured in a second sample obtained from the subject after administering the composition to the subject.

132. The use of embodiment 118, wherein the composition reduces circulating glucose relative to the baseline glucose measurement.

133. The use of embodiment 132, wherein the reduced glucose is measured in a second sample obtained from the subject after administering the composition to the subject.

134. The use of embodiment 119, wherein the composition improves insulin sensitivity relative to the baseline insulin sensitivity measurement.

135. The use of embodiment 134, wherein the improves insulin sensitivity is measured in a second sample obtained from the subject after administering the composition to the subject.

136. The use of embodiment 123, wherein the composition reduces circulating ANGPTL4 protein levels relative to the baseline ANGPTL4 protein measurement.

137. The use of embodiment 136, wherein the reduced ANGPTL4 protein levels are measured in a second sample obtained from the subject after administering the composition to the subject.

138. The use of embodiment 124 or 125, wherein the composition reduces ANGPTL4 mRNA levels relative to the baseline ANGPTL4 mRNA measurement.

139. The use of embodiment 138, wherein the reduced ANGPTL4 mRNA levels are measured in a second sample obtained from the subject after administering the composition to the subject.

140. The use of any one of embodiments 94-139, wherein the oligonucleotide comprises a modified internucleoside linkage.

141. The use of embodiment 140, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

142. The use of embodiment 140, wherein the modified internucleoside linkage comprises one or more phosphorothioate linkages.

143. The use of any one of embodiments 94-142, wherein the oligonucleotide comprises 1, 2, 3, 4, 5, 6, 7, 8, 9, 10, 11, 12, 13, 14, 15, 16, 17, 18, 19, or 20 modified internucleoside linkages.

144. The use of any one of embodiments 94-143, wherein the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

145. The use of any one of embodiments 94-144, wherein the oligonucleotide comprises a modified nucleoside.

146. The use of embodiment 145, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

147. The use of embodiment 145, wherein the modified nucleoside comprises a LNA.

148. The use of embodiment 145, wherein the modified nucleoside comprises a 2',4' constrained ethyl nucleic acid.

149. The use of embodiment 145, wherein the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

150. The use of embodiment 145, wherein the modified nucleoside comprises one or more 2'fluoro modified nucleosides.

151. The use of embodiment 145, wherein the modified nucleoside comprises a 2' O-alkyl modified nucleoside.

152. The use of embodiment 145, wherein the oligonucleotide comprises a lipid attached at a 3' or 5' terminus of the oligonucleotide.

153. The use of embodiment 152, wherein the lipid comprises cholesterol, myristoyl, palmitoyl, stearoyl, lithocholoyl, docosanoyl, docosahexaenoyl, myristyl, palmityl stearyl, or α-tocopherol, or a combination thereof.

154. The use of any one of embodiments 94-153, wherein the oligonucleotide comprises 1, 2, 3, 4, 5, 6, 7, 8, 9, 10, 11, 12, 13, 14, 15, 16, 17, 18, 19, 20, or 21 modified nucleosides.

155. The use of any one of embodiments 94-154, wherein the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

156. The use of any one of embodiments 94-155, wherein the oligonucleotide comprises an N-acetylgalactosamine (GalNAc) ligand for hepatocyte targeting.

157. The use of any one of embodiments 94-156, wherein the oligonucleotide comprises an siRNA comprising a sense strand and an antisense strand.

158. The use of embodiment 157, wherein the sense strand is 14-30 nucleosides in length.

159. The use of embodiment 157 or 158, wherein the antisense strand is 14-30 nucleosides in length.

160. The use of any one of embodiments 94-156, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13935.

161. The use of any one of embodiments 94-156, wherein the oligonucleotide comprises an siRNA comprising a sense strand and an antisense strand, each strand is independently about 14-30 nucleosides in length, and at least one of the sense strand and the antisense strand comprises a nucleoside sequence comprising about 14-30 contiguous nucleosides of SEQ ID NO: 13936.

162. The use of any one of embodiments 157-161, wherein the sense strand and the antisense strand form a double-stranded RNA duplex.

163. The use of embodiment 162, wherein the first base pair of the double-stranded RNA duplex is an AU base pair.

164. The use of any one of embodiments 157-163, wherein the sense strand comprises a 3' overhang comprising 1, 2, or more nucleosides.

165. The use of embodiment 164, wherein the 3' overhang of the sense strand comprises 2 nucleosides.

166. The use of any one of embodiments 157-165, wherein the antisense strand comprises a 3' overhang comprising 1, 2, or more nucleosides.

167. The use of embodiment 166, wherein the 3' overhang of the antisense strand comprises 2 nucleosides.

168. The use of any one of embodiments 157-167, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions.

169. The use of any one of embodiments 157-168, wherein the sense strand comprises a nucleoside sequence comprising or consisting of the sequence of any one of SEQ ID NOs: 1-1854 or 13970-13977.

170. The use of any one of embodiments 157-169, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions.

171. The use of any one of embodiments 157-170, wherein the antisense strand comprises a nucleoside sequence comprising or consisting of the sequence of any one of SEQ ID NOs: 1855-3708 or 13978-13985.

172. The use of any one of embodiments 157-171, wherein the siRNA binds with a 17mer in a non-human primate ANGPTL4 mRNA.

173. The use of any one of embodiments 157-172, wherein the siRNA binds with a 19mer in a human ANGPTL4 mRNA.

174. The use of any one of embodiments 157-173, wherein the siRNA binds with a human ANGPTL4 mRNA and less than or equal to 20 human off-targets, with no more than 2 mismatches in the antisense strand.

175. The use of any one of embodiments 157-174, wherein the siRNA binds with a human ANGPTL4 mRNA target site that does not harbor an SNP, with a minor allele frequency (MAF) greater or equal to 1% (pos. 2-18).

176. The use of any one of embodiments 157-175, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803, or a nucleic acid sequence thereof having 1 or 2 nucleoside substitutions, additions, or deletions; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657, or a nucleic acid sequence thereof having 1 or 2 nucleoside substitutions, additions, or deletions.

177. The use of any one of embodiments 157-176, wherein the sense strand comprises the nucleoside sequence of any one of SEQ ID NOs: 32, 33, 34, 35, 36, 56, 57, 58, 59, 61, 62, 63, 64, 79, 80, 84, 111, 112, 116, 117, 118, 119, 120, 121, 125, 126, 127, 128, 129, 149, 150, 152, 153, 154, 157, 158, 159, 161, 164, 165, 166, 167, 168, 169, 172, 174, 175, 177, 196, 198, 199, 210, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 282, 289, 290, 291, 292, 293, 299, 304, 321, 323, 325, 326, 328, 329, 330, 331, 332, 333, 334, 335, 337, 338, 339, 342, 347, 349, 350, 352, 353, 356, 377, 380, 382, 386, 388, 391, 392, 393, 394, 397, 398, 399, 402, 404, 405, 411, 412, 413, 414, 415, 417, 419, 420, 421, 422, 423, 424, 425, 426, 427, 428, 429, 430, 431, 435, 481, 484, 506, 509, 517, 519, 520, 565, 570, 571, 572, 589, 607, 608, 610, 611, 612, 616, 617, 620, 623, 635, 637, 640, 643, 653, 672, 673, 674, 675, 676, 677, 678, 679, 681, 682, 683, 684, 686, 687, 689, 692, 695, 830, 834, 841, 842, 843, 844, 850, 851, 852, 853, 854, 856, 857, 859, 866, 868, 871, 872, 876, 887, 888, 890, 892, 893, 894, 897, 900, 902, 907, 911, 912, 913, 914, 915, 916, 917, 918, 919, 920, 921, 922, 925, 945, 968, 1001, 1002, 1005, 1006, 1009, 1010, 1011, 1013, 1028, 1032, 1037, 1052, 1053, 1054, 1055, 1057, 1058, 1064, 1112, 1122, 1124, 1126, 1127, 1133, 1134, 1136, 1137, 1147, 1148, 1149, 1151, 1153, 1154, 1155, 1157, 1158, 1161, 1162, 1163, 1164, 1165, 1166, 1171, 1172, 1175, 1181, 1182, 1184, 1248, 1249, 1252, 1253, 1259, 1276, 1285, 1310, 1315, 1338, 1343, 1347, 1348, 1349, 1350, 1351, 1352, 1378, 1405, 1407, 1413, 1414, 1415, 1416, 1417, 1418, 1429, 1430, 1448, 1477, 1487, 1488, 1489, 1493, 1494, 1519, 1523, 1538, 1556, 1561, 1563, 1564, 1565, 1570, 1571, 1572, 1580, 1581, 1589, 1597, 1598, 1601, 1602, 1603, 1604, 1605, 1606, 1610, 1611, 1613, 1614, 1617, 1693, 1699, 1701, 1702, 1703, 1722, 1740, 1741, 1742, 1745, 1747, 1748, 1749, 1751, 1754, 1755, 1779, 1780, 1784, 1787, 1788, 1798, 1799, 1800, 1801, 1802, or 1803; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1938, 1965, 1966, 1970, 1971, 1972, 1973, 1974, 1975, 1979, 1980, 1981, 1982, 1983, 2003, 2004, 2006, 2007, 2008, 2011, 2012, 2013, 2015, 2018, 2019, 2020, 2021, 2022, 2023, 2026, 2028, 2029, 2031, 2050, 2052, 2053, 2064, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2136, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2231, 2234, 2236, 2240, 2242, 2245, 2246, 2247, 2248, 2251, 2252, 2253, 2256, 2258, 2259, 2265, 2266, 2267, 2268, 2269, 2271, 2273, 2274, 2275, 2276, 2277, 2278, 2279, 2280, 2281, 2282, 2283, 2284, 2285, 2289, 2335, 2338, 2360, 2363, 2371, 2373, 2374, 2419, 2424, 2425, 2426, 2443, 2461, 2462, 2464, 2465, 2466, 2470, 2471, 2474, 2477, 2489, 2491, 2494, 2497, 2507, 2526, 2527, 2528, 2529, 2530, 2531, 2532, 2533, 2535, 2536, 2537, 2538, 2540, 2541, 2543, 2546, 2549, 2684, 2688, 2695, 2696, 2697, 2698, 2704, 2705, 2706, 2707, 2708, 2710, 2711, 2713, 2720, 2722, 2725, 2726, 2730, 2741, 2742, 2744, 2746, 2747, 2748, 2751, 2754, 2756, 2761, 2765, 2766, 2767, 2768, 2769, 2770, 2771, 2772, 2773, 2774, 2775, 2776, 2779, 2799, 2822, 2855, 2856, 2859, 2860, 2863, 2864, 2865, 2867, 2882, 2886, 2891, 2906, 2907, 2908, 2909, 2911, 2912, 2918, 2966, 2976, 2978, 2980, 2981, 2987, 2988, 2990, 2991, 3001, 3002, 3003, 3005, 3007, 3008, 3009, 3011, 3012, 3015, 3016, 3017, 3018, 3019, 3020, 3025, 3026, 3029, 3035, 3036, 3038, 3102, 3103, 3106, 3107, 3113, 3130, 3139, 3164, 3169, 3192, 3197, 3201, 3202, 3203, 3204, 3205, 3206, 3232, 3259, 3261, 3267, 3268, 3269, 3270, 3271, 3272, 3283, 3284, 3302, 3331, 3341, 3342, 3343, 3347, 3348, 3373, 3377, 3392, 3410, 3415, 3417, 3418, 3419, 3424, 3425, 3426, 3434, 3435, 3443, 3451, 3452, 3455, 3456, 3457, 3458, 3459, 3460, 3464, 3465, 3467, 3468, 3471, 3547, 3553, 3555, 3556, 3557, 3576, 3594, 3595, 3596, 3599, 3601, 3602, 3603, 3605, 3608, 3609, 3633, 3634, 3638, 3641, 3642, 3652, 3653, 3654, 3655, 3656, or 3657.

178. The use of any one of embodiments 157-177, wherein the sense strand comprises the nucleoside sequence of any one of SEQ ID NOs: 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, or 1787; and wherein the antisense strand comprises the nucleoside sequence of any one of SEQ ID NOs: 1887, 1888, 1889, 1890, 1910, 1975, 2126, 2134, 2136, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2335, 2338, 2363, 2371, 2373, 2374, 2419, 2474, 2489, 2491, 2494, 2684, 2688, 2695, 2696, 2697, 2698, 2704, 2725, 2726, 2730, 2741, 2742, 2748, 2751, 2756, 2799, 2855, 2856, 2859, 2891, 2987, 2988, 2991, 3003, 3005, 3007, 3008, 3009, 3011, 3012, 3015, 3016, 3018, 3019, 3020, 3025, 3026, 3102, 3103, 3169, 3192, 3197, 3201, 3202, 3283, 3284, 3424, 3425, 3426, 3464, 3465, 3471, 3634, 3638, or 3641.

179. The use of any one of embodiments 157-178, wherein the sense strand comprises the nucleoside sequence of any one of SEQ ID NOs: 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, or 1803; and wherein the antisense strand comprises the nucleoside sequence of any one of SEQ ID NOs: 1886, 1887, 1888, 1889, 1890, 1910, 1911, 1912, 1913, 1915, 1916, 1917, 1918, 1933, 1934, 1966, 1970, 1971, 1972, 1973, 1974, 1979, 1980, 1981, 1982, 1983, 2003, 2004, 2006, 2007, 2011, 2012, 2013, 2015, 2018, 2019, 2020, 2021, 2022, 2023, 2026, 2028, 2029, 2050, 2053, 2065, 2066, 2068, 2069, 2070, 2071, 2072, 2073, 2075, 2076, 2077, 2082, 2084, 2085, 2094, 2095, 2099, 2100, 2104, 2106, 2107, 2108, 2109, 2114, 2115, 2116, 2117, 2119, 2120, 2125, 2126, 2128, 2134, 2143, 2144, 2145, 2146, 2147, 2153, 2158, 2175, 2177, 2179, 2180, 2182, 2183, 2184, 2185, 2186, 2187, 2188, 2189, 2191, 2192, 2193, 2196, 2201, 2203, 2204, 2206, 2207, 2210, 2234, 2236, 2240, 2242, 2245, 2246, 2247, 2248, 2251, 2252, 2253, 2256, 2258, 2259, 2265, 2266, 2267, 2268, 2269, 2274, 2275, 2276, 2277, 2278, 2279, 2280, 2281, 2282, 2283, 2284, 2285, 2289, 2338, 2371, 2373, 2374, 2419, 2424, 2425, 2426, 2461, 2462, 2464, 2465, 2466, 2470, 2471, 2474, 2489, 2491, 2494, 2526, 2527, 2528, 2529, 2530, 2531, 2532, 2533, 2535, 2536, 2537, 2538, 2540, 2541, 2543, 2546, 2549, 2684, 2695, 2696, 2697, 2698, 2704, 2705, 2706, 2707, 2708, 2710, 2711, 2720, 2722, 2725, 2726, 2730, 2741, 2742, 2744, 2746, 2747, 2748, 2756, 2765, 2766, 2767, 2768, 2769, 2770, 2771, 2772, 2773, 2774, 2775, 2776, 2799, 2855, 2856, 2859, 2860, 2863, 2864, 2865, 2867, 2882, 2886, 2906, 2907, 2908, 2909, 2911, 2912, 2966, 2976, 2978, 2980, 2981, 2987, 2988, 3001, 3002, 3003, 3005, 3007, 3008, 3009, 3011, 3012, 3015, 3016, 3018, 3019, 3020, 3029, 3036, 3038, 3106, 3107, 3113, 3130, 3139, 3164, 3169, 3197, 3201, 3202, 3203, 3204, 3205, 3259, 3261, 3267, 3268, 3269, 3270, 3271, 3272, 3283, 3284, 3302, 3373, 3377, 3410, 3415, 3417, 3418, 3419, 3425, 3426, 3434, 3435, 3443, 3451, 3455, 3456, 3457, 3458, 3459, 3460, 3465, 3467, 3468, 3547, 3553, 3555, 3556, 3557, 3576, 3594, 3595, 3596, 3599, 3601, 3602, 3603, 3605, 3608, 3609, 3633, 3634, 3638, 3642, 3652, 3653, 3655, 3656, or 3657.

180. The use of any one of embodiments 157-179, wherein the sense strand comprises the nucleoside sequence of any one of SEQ ID NOs: 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, or 1784; and wherein the antisense strand comprises the nucleoside sequence of any one of SEQ ID NOs: 1887, 1888, 1889, 1890, 1910, 2126, 2134, 2143, 2144, 2145, 2146, 2147, 2175, 2177, 2180, 2182, 2183, 2184, 2185, 2186, 2187, 2188, 2189, 2191, 2192, 2193, 2196, 2201, 2203, 2265, 2266, 2284, 2285, 2289, 2338, 2371, 2373, 2374, 2419, 2474, 2489, 2491, 2494, 2684, 2695, 2696, 2697, 2698, 2704, 2725, 2726, 2730, 2741, 2742, 2748, 2756, 2799, 2855, 2856, 2859, 2987, 2988, 3003, 3005, 3007, 3008, 3009, 3011, 3012, 3015, 3016, 3018, 3019, 3020, 3169, 3197, 3201, 3202, 3283, 3284, 3425, 3426, 3465, 3634, or 3638.

181. The use of any one of embodiments 157-180, wherein the antisense strand comprises a seed region that is not identical to a seed region of a human miRNA.

182. The use of any one of embodiments 157-181, wherein the sense strand comprises the nucleoside sequence of any one of SEQ ID NOs: 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, or 1803, or 3638; and wherein the antisense strand comprises the nucleoside sequence of any one of SEQ ID NOs: 1886, 1890, 1910, 1911, 1912, 1915, 1916, 1933, 1934, 1971, 1973, 1979, 1980, 1982, 2003, 2006, 2011, 2012, 2013, 2015, 2019, 2020, 2021, 2022, 2023, 2028, 2050, 2065, 2066, 2071, 2072, 2073, 2084, 2085, 2099, 2100, 2107, 2114, 2115, 2116, 2125, 2126, 2134, 2143, 2145, 2146, 2147, 2158, 2175, 2177, 2179, 2180, 2182, 2184, 2185, 2186, 2187, 2188, 2191, 2192, 2196, 2201, 2203, 2206, 2207, 2210, 2234, 2236, 2240, 2242, 2245, 2246, 2248, 2253, 2267, 2268, 2269, 2276, 2277, 2278, 2279, 2280, 2289, 2371, 2373, 2374, 2419, 2425, 2461, 2462, 2466, 2471, 2474, 2489, 2494, 2526, 2527, 2528, 2529, 2532, 2533, 2535, 2537, 2538, 2541, 2546, 2696, 2697, 2704, 2705, 2708, 2720, 2722, 2730, 2746, 2747, 2756, 2765, 2766, 2767, 2768, 2770, 2773, 2799, 2855, 2856, 2860, 2864, 2882, 2906, 2907, 2908, 2909, 2911, 2966, 2978, 2981, 3001, 3003, 3005, 3007, 3009, 3011, 3018, 3029, 3036, 3038, 3113, 3130, 3139, 3169, 3197, 3203, 3204, 3205, 3259, 3261, 3267, 3269, 3272, 3418, 3425, 3435, 3443, 3451, 3455, 3456, 3457, 3458, 3459, 3460, 3467, 3468, 3547, 3555, 3576, 3594, 3599, 3605, 3609, 3655, 3656, or 3657.

183. The use of any one of embodiments 157-182, wherein the sense strand comprises the nucleoside sequence of any one of SEQ ID 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, or 1571; and wherein the antisense strand comprises the nucleoside sequence of any one of SEQ ID 1890, 1910, 2126, 2134, 2143, 2145, 2146, 2147, 2175, 2177, 2180, 2182, 2184, 2185, 2186, 2187, 2188, 2191, 2192, 2196, 2201, 2203, 2289, 2371, 2373, 2374, 2419, 2474, 2489, 2494, 2696, 2697, 2704, 2730, 2756, 2799, 2855, 2856, 3003, 3005, 3007, 3009, 3011, 3018, 3169, 3197, or 3425.

184. The use of any one of embodiments 157-183, wherein the sense strand comprises a seed region that is not identical to a seed region of a human miRNA.

185. The use of any one of embodiments 157-184, wherein the sense strand comprises the nucleoside sequence of any one of SEQ ID NOs: 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, or 1787; and wherein the antisense strand comprises the nucleoside sequence of any one of SEQ ID NOs: 1886, 1890, 1910, 1912, 1915, 1916, 1934, 1971, 1973, 1980, 2006, 2008, 2011, 2012, 2013, 2015, 2020, 2023, 2028, 2031, 2050, 2065, 2066, 2071, 2072, 2084, 2085, 2099, 2107, 2114, 2115, 2125, 2126, 2134, 2143, 2147, 2158, 2182, 2184, 2185, 2186, 2187, 2188, 2191, 2196, 2201, 2203, 2207, 2210, 2240, 2242, 2245, 2246, 2248, 2268, 2269, 2276, 2277, 2278, 2280, 2289, 2374, 2425, 2462, 2466, 2471, 2507, 2526, 2532, 2533, 2535, 2537, 2546, 2696, 2697, 2705, 2708, 2713, 2730, 2746, 2754, 2767, 2768, 2773, 2822, 2855, 2856, 2908, 2911, 2918, 2966, 2978, 3011, 3018, 3036, 3038, 3102, 3113, 3197, 3205, 3206, 3269, 3272, 3418, 3435, 3456, 3468, 3547, 3555, 3576, 3594, 3605, 3609, or 3641.

186. The use of any one of embodiments 157-185, wherein the sense strand comprises the nucleoside sequence of any one of SEQ ID NOs: 36, 56, 272, 280, 289, 293, 328, 330, 331, 332, 333, 334, 337, 342, 347, 349, 435, 520, 842, 843, 876, 1001, 1002, 1157, 1164, or 1343; and wherein the antisense strand comprises the nucleoside sequence of any one of SEQ ID NOs: 1890, 1910, 2126, 2134, 2143, 2147, 2182, 2184, 2185, 2186, 2187, 2188, 2191, 2196, 2201, 2203, 2289, 2374, 2696, 2697, 2730, 2855, 2856, 3011, 3018, or 3197.

187. The use of any one of embodiments 157-186, wherein the sense strand comprises modification pattern 1S: 5'-NfsnsNfnNfnNfNfNfnNfnNfnNfnNfnNfnNfsnsn-3', wherein "Nf" is a 2' fluoro-modified nucleoside, "n" is a 2' O-methyl modified nucleoside, and "s" is a phosphorothioate linkage.

188. The use of any one of embodiments 157-186, wherein the sense strand comprises modification pattern 2S: 5'-nsnsnnNfnNfNfNfnnnnnnnnnnsnsn-3', wherein "Nf" is a 2' fluoro-modified nucleoside, "n" is a 2' O-methyl modified nucleoside, and "s" is a phosphorothioate linkage.

189. The use of any one of embodiments 157-186, wherein the sense strand comprises modification pattern 3S: 5'-nsnsnnNfnNfnNfnnnnnnnnnnsnsn-3', wherein "Nf" is a 2' fluoro-modified nucleoside, "n" is a 2' O-methyl modified nucleoside, and "s" is a phosphorothioate linkage.

190. The use of any one of embodiments 157-186, wherein the sense strand comprises modification pattern 4S: 5'-NfsnsNfnNfnNfNfNfnNfnNfnNfnNfnNfsnsnN-3', wherein "Nf" is a 2' fluoro-modified nucleoside, "n" is a 2' O-methyl modified nucleoside, "s" is a phosphorothioate linkage, and N comprises one or more nucleosides.

191. The use of any one of embodiments 157-186, wherein the sense strand comprises modification pattern 5S: 5'-nsnsnnNfnNfNfNfnnnnnnnnnnsnsnN-3', wherein "Nf" is a 2' fluoro-modified nucleoside, "n" is a 2' O-methyl modified nucleoside, "s" is a phosphorothioate linkage, and N comprises one or more nucleosides.

192. The use of any one of embodiments 157-192, wherein the antisense strand comprises modification pattern 1AS: 5'-nsNfsnNfnNfnNfnNfnnnNfnNfnNfsnsn-3', wherein "Nf" is a 2' fluoro-modified nucleoside, "n" is a 2' O-methyl modified nucleoside, and "s" is a phosphorothioate linkage.

193. The use of any one of embodiments 157-192, wherein the antisense strand comprises modification pattern 2AS: 5'-nsNfsnnnNfnNfNfnnnnNfnNfnnnsnsn-3', wherein "Nf" is a 2' fluoro-modified nucleoside, "n" is a 2' O-methyl modified nucleoside, and "s" is a phosphorothioate linkage.

194. The use of any one of embodiments 157-192, wherein the antisense strand comprises modification pattern 3AS: 5'-nsNfsnnnNfnnnnnnnnNfnNfnnnsnsn-3', wherein "Nf" is a 2' fluoro-modified nucleoside, "n" is a 2' O-methyl modified nucleoside, and "s" is a phosphorothioate linkage.

195. The use of any one of embodiments 157-192, wherein the antisense strand comprises modification pattern 4AS: 5'-nsNfsnNfnNfnnnnnnnnNfnNfnnnsnsn-3', wherein "Nf" is a 2' fluoro-modified nucleoside, "n" is a 2' O-methyl modified nucleoside, and "s" is a phosphorothioate linkage.

196. The use of any one of embodiments 157-186, wherein the sense strand comprises modification pattern 1S and the antisense strand comprises modification pattern 1AS, 2AS, 3AS, or 4AS.

197. The use of any one of embodiments 157-186, wherein the sense strand comprises modification pattern 2S and the antisense strand comprises modification pattern 1AS, 2AS, 3AS, or 4AS.

198. The use of any one of embodiments 157-186, wherein the sense strand comprises modification pattern 3S and the antisense strand comprises modification pattern 1AS, 2AS, 3AS, or 4AS.

199. The use of any one of embodiments 157-186, wherein the sense strand comprises modification pattern 4S and the antisense strand comprises modification pattern 1AS, 2AS, 3AS, or 4AS.

200. The use of any one of embodiments 157-186, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 1S.

201. The use of any one of embodiments 157-186, wherein the sense strand comprises a nucleoside sequence comprising or consisting of the sequence of any one of SEQ ID NOs: 1-1854 or 13970-13977, and modification pattern 1S.

202. The use of any one of embodiments 157-186, wherein the sense strand comprises a nucleoside sequence comprising or consisting of the sequence of any one of SEQ ID NOs: 1-1854 or 13970-13977, or a nucleic acid sequence thereof having 1 or 2 nucleoside substitutions, additions, or deletions, and modification pattern 2S.

203. The use of any one of embodiments 157-186, wherein the sense strand comprises a nucleoside sequence comprising or consisting of the sequence of any one of SEQ ID NOs: 1-1854 or 13970-13977, and modification pattern 2S.

204. The use of any one of embodiments 157-186 or 200-203, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 1AS.

205. The use of any one of embodiments 157-186 or 200-203, wherein the antisense strand comprises a nucleoside sequence comprising or consisting of the sequence of any one of SEQ ID NOs: 1855-3708 or 13978-13985, and modification pattern 1AS.

206. The use of any one of embodiments 157-186 or 200-203, wherein the antisense strand comprises a nucleoside sequence comprising or consisting of the sequence of any one of SEQ ID NOs: 1855-3708 or 13978-13985, or a nucleic acid sequence thereof having 1 or 2 nucleoside substitutions, additions, or deletions, and modification pattern 3AS.

207. The use of any one of embodiments 157-186 or 200-203, wherein the antisense strand comprises a nucleoside sequence comprising or consisting of the sequence of any one of SEQ ID NOs: 1855-3708 or 13978-13985, and modification pattern 3AS.

208. The use of any one of embodiments 90-156, wherein the oligonucleotide comprises an ASO.

209. The use of embodiment 208, wherein the ASO is 12-30 nucleosides in length. 210. The use of any one of embodiments 90-156, wherein the oligonucleotide comprises an antisense oligonucleotide (ASO) about 12-30 nucleosides in length and comprising a nucleoside sequence complementary to about 12-30 contiguous nucleosides of SEQ ID NO: 13935.

211. The use of any one of embodiments 90-156, wherein the oligonucleotide comprises an ASO about 12-30 nucleosides in length and comprising a nucleoside sequence complementary to about 12-30 contiguous nucleosides of SEQ ID NO: 13936.

212. The use of any one of embodiments 208-211, wherein the ASO is 15-25 nucleosides in length.

213. The use of any one of embodiments 208-212, wherein the ASO is 20 nucleosides in length.

214. The use of any one of embodiments 208-213, wherein the ASO comprises a nucleoside sequence comprising or consisting of the sequence of any one of SEQ ID NOs: 3709-13934, or a nucleic acid sequence thereof having 1 or 2 nucleoside substitutions, additions, or deletions.

215. The use of any one of embodiments 208-214, wherein the ASO comprises a nucleoside sequence comprising or consisting of the sequence of any one of SEQ ID NOs: 3709-13934.

216. The use of any one of embodiments 208-215, wherein the ASO comprises modification pattern: 5'-nsnsnsnsnsdNsdNsdNsdNsdNsdNsdNsdNsdNsnsns-nsnsn-3' where "dN" is any deoxynucleotide, "n" is a 2'O-methyl or 2'O-methoxyethyl-modified nucleoside, and "s" is a phosphorothioate linkage.

217. The use of any one of embodiments 208-215, wherein the ASO comprises a nucleoside sequence comprising or consisting of the sequence of any one of SEQ ID NOs: 3709-13934, or a nucleic acid sequence thereof having 1 or 2 nucleoside substitutions, additions, or deletions, and modification pattern ASO1.

218. The use of any one of embodiments 208-215, wherein the ASO comprises a nucleoside sequence comprising or consisting of the sequence of any one of SEQ ID NOs: 3709-13934, and modification pattern ASO1.

219. The use of any one of embodiments 90-218, wherein the composition is a pharmaceutical composition.

220. The use of any one of embodiments 90-219, wherein the composition is sterile. 221. The use of any one of embodiments 90-220, further comprising a pharmaceutically acceptable carrier.

222. The use of embodiment 221, wherein the pharmaceutically acceptable carrier comprises water, a buffer, or a saline solution.

223. The composition of any one of embodiments 28-57, wherein the sense strand comprises modification pattern 6S.

224. The composition of any one of embodiments 28-62 or 223, wherein the antisense strand comprises modification pattern 5AS.

225. The composition of any one of embodiments 28-62 or 223, wherein the antisense strand comprises modification pattern 6AS.

226. The composition of any one of embodiments 28-62 or 223, wherein the antisense strand comprises modification pattern 7AS.

227. The composition of any one of embodiments 28-62 or 223, wherein the antisense strand comprises modification pattern 8AS.

228. The composition of any one of embodiments 28-62 or 223, wherein the antisense strand comprises modification pattern 9AS.

229. The use of any one of embodiments 157-186, wherein the sense strand comprises modification pattern 6S.

230. The use of any one of embodiments 157-192 or 229, wherein the antisense strand comprises modification pattern 5AS.

231. The use of any one of embodiments 157-192 or 229, wherein the antisense strand comprises modification pattern 6AS.

232. The use of any one of embodiments 157-192 or 229, wherein the antisense strand comprises modification pattern 7AS.

233. The use of any one of embodiments 157-192 or 229, wherein the antisense strand comprises modification pattern 8AS.

234. The use of any one of embodiments 157-192 or 229, wherein the antisense strand comprises modification pattern 9AS.

VI. Further Embodiments

Some embodiments include one or more of the following:

1. A composition comprising an oligonucleotide that targets Angiopoietin-like 4 (ANGPTL4) and when administered to a subject in an effective amount decreases circulating triglycerides, decreases circulating total cholesterol, decreases circulating glucose, increases circulating high-density lipoproteins (HDL), or increases insulin sensitivity, wherein the oligonucleotide comprises a small interfering RNA (siRNA) comprising a sense strand and an antisense strand, the antisense strand being complementary with no more than 2 mismatches to a portion of a nucleic acid having the nucleoside sequence of SEQ ID NO: 13936, and each strand having 12 to 30 nucleotides.

2. The composition of embodiment 1, wherein the triglycerides, total cholesterol, or glucose is decreased by about 10% or more, or the HDL or insulin sensitivity is increased by about 10% or more, as compared to prior to administration.

3. The composition of embodiment 1 or 2, wherein the antisense strand is complementary with no more than 2 mismatches to a portion of a nucleic acid having the nucleoside sequence of SEQ ID NO: 13935.

4. The composition of any one of embodiments 1-3, wherein the antisense strand comprises a nucleoside sequence at least 85% identical to any antisense strand sequence of an siRNA in Table 4.

5. The composition of any one of embodiments 1-3, wherein the antisense strand comprises the nucleoside sequence of any antisense strand sequence of an siRNA in Table 4, or an antisense strand sequence thereof having 1 or 2 nucleoside substitutions, additions, or deletions.

6. The composition of any one of embodiments 1-3, wherein the antisense strand comprises the nucleoside sequence of any antisense strand sequence of an siRNA in Table 4.

7. The composition of any one of embodiments 4-6, wherein the sense strand comprises a nucleoside sequence at least 85% identical to the sense strand sequence of the siRNA in Table 4.

8. The composition of any one of embodiments 4-6, wherein the sense strand comprises the nucleoside sequence of the sense strand sequence of the siRNA in Table 4, or a sense strand sequence thereof having 1 or 2 nucleoside substitutions, additions, or deletions.

9. The composition of any one of embodiments 4-6, wherein the sense strand comprises the nucleoside sequence of the sense strand sequence of the siRNA in Table 4.

10. The composition of any one of embodiments 1-3, wherein the antisense strand comprises a nucleoside sequence at least 85% identical to any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696.

11. The composition of any one of embodiments 1-3, wherein the antisense strand comprises the nucleoside sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or an antisense strand sequence thereof having 1 or 2 nucleoside substitutions, additions, or deletions.

12. The composition of any one of embodiments 1-3, wherein the antisense strand comprises the nucleoside sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696.

13. The composition of any one of embodiments 10-12, wherein the sense strand comprises a nucleoside sequence at least 85% identical to any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842.

14. The composition of any one of embodiments 10-12, wherein the sense strand comprises the nucleoside sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, or a sense strand sequence thereof having 1 or 2 nucleoside substitutions, additions, or deletions.

15. The composition of any one of embodiments 10-12, wherein the sense strand comprises the nucleoside sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842.

16. The composition of any one of embodiments 1-3, wherein the antisense strand comprises a nucleoside sequence at least 85% identical to any one of SEQ ID NOS: 13978-13981.

17. The composition of any one of embodiments 1-3, wherein the antisense strand comprises the nucleoside sequence of any one of SEQ ID NOS: 13978-13981, or an antisense strand sequence thereof having 1 or 2 nucleoside substitutions, additions, or deletions.

18. The composition of any one of embodiments 1-3, wherein the antisense strand comprises the nucleoside sequence of any one of SEQ ID NOS: 13978-13981.

19. The composition of any one of embodiments 16-18, wherein the sense strand comprises a nucleoside sequence at least 85% identical to any one of SEQ ID NOS: 13970-13973.

20. The composition of any one of embodiments 16-18, wherein the sense strand comprises the nucleoside sequence of any one of SEQ ID NOS: 13970-13973, or a sense strand sequence thereof having 1 or 2 nucleoside substitutions, additions, or deletions.

21. The composition of any one of embodiments 16-18, wherein the sense strand comprises the nucleoside sequence of any one of SEQ ID NOS: 13970-13973.

22. The composition of any one of embodiments 1-21, wherein the oligonucleotide comprises one or more modified internucleoside linkages.

23. The composition of embodiment 22, wherein the one or more modified internucleoside linkages comprise alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

24. The composition of embodiment 22 or 23, wherein the one or more modified internucleoside linkages comprise a phosphorothioate linkage.

25. The composition of any one of embodiments 22-24, wherein the sense strand comprises 2-6 modified internucleoside linkages.

26. The composition of any one of embodiments 22-25, wherein the antisense strand comprises 2-6 modified internucleoside linkages.

27. The composition of any one of embodiments 1-26, wherein the oligonucleotide comprises one or more modified nucleosides.

28. The composition of embodiment 27, wherein the one or more modified nucleosides comprise a locked nucleic acid (LNA), hexitol nucleic acid (HLA), cyclohexene nucleic acid (CeNA), a 2',4' constrained ethyl, 2'-methoxyethyl, 2'-O-alkyl, 2'-O-allyl, 2'-O-allyl, 2'-fluoro, 2'-deoxy, a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, 2'-ara-F, or a combination thereof.

29. The composition of embodiment 27 or 28, wherein the one or more modified nucleosides comprise a 2' fluoro modified nucleoside.

30. The composition of any one of embodiments 27-29, wherein the one or more modified nucleosides comprise a 2' O-methyl modified nucleoside.

31. The composition of any one of embodiments 27-30, wherein the sense strand comprises 15-21 modified nucleosides, and/or the antisense strand comprises 15-21 modified nucleosides.

32. The composition of any one of embodiments 1-31, wherein the sense strand or the antisense strand comprises a 3' overhang of at least 2 nucleosides.

33. The composition of any one of embodiments 1-32, wherein the oligonucleotide comprises a GalNAc ligand attached at a 3' or 5' terminus of the sense strand.

34. The composition of any one of embodiments 1-33, wherein the oligonucleotide comprises a GalNAc ligand attached at a 3' or 5' terminus of the antisense strand 35. The composition of any one of embodiments 1-34, wherein the sense strand comprises modification pattern 1S: 5'-NfsnsNfnNfnNfNfNfnNfnNfnNfnNfnNfsnsn-3' (SEQ ID NO: 13954), modification pattern 2S: 5'-nsnsnnNfnNfNf Nfnnnnnnnnnnsnsn-3' (SEQ ID NO: 13955), modification pattern 3S: 5'-nsnsnnNfnNfnNfnnnnnnnnnnsnsn-3' (SEQ ID NO: 13956), modification pattern 4S: 5'-NfsnsNfnNfnNfnNfnNfnNfnNfnNfnNfnNfnNfnNfsnsn-3' (SEQ ID NfnNfnNfnNfnNfnNfsnsnN-3'(SEQIDNO:13957), modification pattern 5S: 5'-nsnsnnNfnNfNfNfnnnn nnnnnnsnsnN-3' (SEQ ID NO: 13958); modification pattern 6S: 5'-NfsnsNfnNfnNfnNfnNfnNfnNfnNfnNfsnsn-3' (SEQ ID NO: 13959); wherein "Nf" is a 2' fluoro-modified nucleoside, "n" is a 2' O-methyl modified nucleoside, "s" is a phosphorothioate linkage, and N comprises a nucleoside.

36. The composition of any one of embodiments 1-35, wherein the antisense strand comprises modification pattern 1AS: 5'-nsNfsnNfnNfnNfnNfnnnNfnNfnNfsnsn-3' (SEQ ID NO: 13960), modification pattern 2AS: 5'-nsNfsnnnNfn NfNfnnnnNfnNfnnnsnsn-3' (SEQ ID NO: 13961), modification pattern 3AS: 5'-nsNfsnnnNfnnnnnnnNfnNfnnnsnsn-3' (SEQ ID NO: 13962), modification pattern 4AS: 5'-nsNf snNfnNfnnnnnnnNfnNfnnnsnsn-3' (SEQ ID NO: 13963), modification pattern 5AS: 5'-nsNfsnnnNfnNfnnnnn NfnNfnnnsnsn-3' (SEQ ID NO: 13964), modification pattern 6AS: 5'-nsNfsnNfnNfnNfnNfnNfnNfnNfnNfsnsn-3' (SEQ ID NO: 13965), modification pattern 7AS: 5'-nsNfsnNfnNfnNfNfnnnnNfnNfnnnsnsn-3' (SEQ ID NO: 13966), modification pattern 8AS: 5'-nsNfsnnnnnnnnnnn Nfnnnnnsnsn-3' (SEQ ID NO: 13967), or modification pattern 9AS: 5'-nsNfsnnnNfnnnnnnnNfnNfnNfnsnsn-3' (SEQ ID NO: 13968); wherein "Nf" is a 2' fluoro-modified nucleoside, "n" is a 2' O-methyl modified nucleoside, and "s" is a phosphorothioate linkage.

37. The composition of any one of embodiments 1-36, wherein the composition is a pharmaceutical composition comprising a pharmaceutically acceptable carrier.

38. The composition of embodiment 37, wherein the pharmaceutically acceptable carrier comprises water, a buffer, or a saline solution.

39. Use of a composition comprising an oligonucleotide that targets ANGPTL4, wherein the oligonucleotide comprises a small interfering RNA (siRNA) comprising a sense strand and an antisense strand, the antisense strand being complementary with no more than 2 mismatches to a portion of a nucleic acid having the nucleoside sequence of SEQ ID NO: 13936, and each strand having 12 to 30 nucleotides, in a method of treating a metabolic or cardiovascular disorder in a subject in need thereof, the method comprising administering to the subject an effective amount of the composition.

40. The use of embodiment 39, wherein the disorder comprises hyperlipidemia, hypertriglyceridemia, diabetes, type 2 diabetes, heart disease, a myocardial infarction, angina pectoris, or atherosclerosis.

41. The use of embodiment 39 or 40, wherein the effective amount of the composition decreases a triglyceride measurement, decreases a cholesterol measurement, decreases a glucose measurement, increases an HDL measurement, or increases an insulin sensitivity measurement in the subject by about 10% or more, relative to a baseline measurement.

42. The use of any one of embodiments 39-41, wherein the antisense strand is complementary with no more than 2 mismatches to a portion of a nucleic acid having the nucleoside sequence of SEQ ID NO: 13935.

43. The use of any one of embodiments 39-42, wherein the antisense strand comprises a nucleoside sequence at least 85% identical to any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696.

44. The use of any one of embodiments 39-42, wherein the antisense strand comprises the nucleoside sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696, or an antisense strand sequence thereof having 1 or 2 nucleoside substitutions, additions, or deletions.

45. The use of any one of embodiments 39-42, wherein the antisense strand comprises the nucleoside sequence of any one of SEQ ID NOS: 1886, 1887, 1889, 1890, 1975, 2134, 2136, 2143, 2144, 2146, 2175, 2177, 2180, 2186, 2188, 2338, 2363, 2373, 2419, 2424, 2425, 2474, 2491, 2494, 2613, 2688, 2730, 2855, 2987, 2988, 2991, 3003, 3005, 3008, 3011, 3019, 3020, 3025, 3026, 3102, 3103, 3139, 3192, 3202, 3284, 3343, 3344, 3418, 3434, 3435, 3443, 3451, 3465, 3556, 3694, or 3696.

46. The use of any one of embodiments 43-45, wherein the sense strand comprises a nucleoside sequence at least 85% identical to any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842.

47. The use of any one of embodiments 43-45, wherein the sense strand comprises the nucleoside sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842, ora sense strand sequence thereof having 1 or 2 nucleoside substitutions, additions, or deletions.

48. The use of any one of embodiments 43-45, wherein the sense strand comprises the nucleoside sequence of any one of SEQ ID NOS: 32, 33, 35, 36, 121, 280, 282, 289, 290, 292, 321, 323, 326, 332, 334, 484, 509, 519, 565, 570, 571, 620, 637, 640, 759, 834, 876, 1001, 1133, 1134, 1137, 1149, 1151, 1154, 1157, 1165, 1166, 1171, 1172, 1248, 1249, 1285, 1338, 1348, 1430, 1489, 1490, 1564, 1580, 1581, 1589, 1597, 1611, 1702, 1840, or 1842.

49. The use of any one of embodiments 39-42, wherein the antisense strand comprises a nucleoside sequence at least 85% identical to any one of SEQ ID NOS: 13978-13981.

50. The use of any one of embodiments 39-42, wherein the antisense strand comprises the nucleoside sequence of any one of SEQ ID NOS: 13978-13981, or an antisense strand sequence thereof having 1 or 2 nucleoside substitutions, additions, or deletions.

51. The use of any one of embodiments 39-42, wherein the antisense strand comprises the nucleoside sequence of any one of SEQ ID NOS: 13978-13981.

52. The use of any one of embodiments 49-51, wherein the sense strand comprises a nucleoside sequence at least 85% identical to any one of SEQ ID NOS: 13970-13973.

53. The use of any one of embodiments 49-51, wherein the sense strand comprises the nucleoside sequence of any one of SEQ ID NOS: 13970-13973, or a sense strand sequence thereof having 1 or 2 nucleoside substitutions, additions, or deletions.

54. The use of any one of embodiments 49-51, wherein the sense strand comprises the nucleoside sequence of any one of SEQ ID NOS: 13970-13973.

55. The use of any one of embodiments 39-54, wherein the oligonucleotide comprises one or more modified internucleoside linkages comprising alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

56. The use of any one of embodiments 39-55, wherein the oligonucleotide comprises one or more modified nucleosides comprising a locked nucleic acid (LNA), hexitol nucleic acid (HLA), cyclohexene nucleic acid (CeNA), a 2',4' constrained ethyl, 2'-methoxyethyl, 2'-O-alkyl, 2'-O-allyl, 2'-O-allyl, 2'-fluoro, 2'-deoxy, a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, 2'-ara-F, or a combination thereof.

57. The use of any one of embodiments 39-56, wherein the sense strand or the antisense strand comprises a 3' overhang of at least 2 nucleosides.

58. The use of any one of embodiments 39-57, wherein the oligonucleotide comprises a GalNAc ligand attached at a 3' or 5' terminus of the sense strand.

59. The use of any one of embodiments 39-58, wherein the oligonucleotide comprises a GalNAc ligand attached at a 3' or 5' terminus of the antisense strand 60. The use of any one of embodiments 39-59, wherein the sense strand comprises modification pattern 1S: 5'-NfsnsNfnNfnNfNfNfnNfnNfnNfnNfnNfsnsn-3' (SEQ ID NO: 13954), modification pattern 2S: 5'-nsnsnnNfnNfNf Nfnnnnnnnnnnnsnsn-3' (SEQ ID NO: 13955), modification pattern 3S: 5'-nsnsnnNfnNfnNfnnnnnnnnnnnsnsn-3' (SEQ ID NO: 13956), modification pattern 4S: 5'-NfsnsNfnNfnNf NfNfnNfnNfnNfnNfnNfsnsnN-3' (SEQ ID NO: 13957), modification pattern 5S: 5'-nsnsnnNfnNfNf Nfnnnnnnnnnnnsnsn N-3' (SEQ ID NO: 13958); modification pattern 6S: 5'-NfsnsNfnNfnNfnNfnNfnNfnNfnNfnNfnNfsnsn-3' (SEQ ID NO: 13959); wherein "Nf" is a 2' fluoro-modified nucleoside, "n" is a 2' O-methyl modified nucleoside, "s" is a phosphorothioate linkage, and N comprises a nucleoside.

61. The use of any one of embodiments 39-60, wherein the antisense strand comprises modification pattern 1AS: 5'-nsNfsnNfnNfnNfnNfnnnNfnNfnNfnsnsn-3' (SEQ ID NO: 13960), modification pattern 2AS: 5'-nsNfsnnnNfnNf NfnrmnNfnNfnnnsnsn-3' (SEQ ID NO: 13961), modification pattern 3AS: 5'-nsNfsnnnNfnrmrmnnNfnNfrmnsnsn-3' (SEQ ID NO: 13962), modification pattern 4AS: 5'-nsNfsn NfnNfnnrmrmnNfnNfnnnsnsn-3' (SEQ ID NO: 13963), modification pattern 5AS: 5'-nsNfsnnnNfnNfrmrmnNfn Nfnnnsnsn-3' (SEQ ID NO: 13964), modification pattern 6AS: 5'-nsNfsnNfnNfnNfnNfnNfnNfnNfnNfnsnsn-3' (SEQ ID NO: 13965), modification pattern 7AS: 5'-nsNfsnNfn NfnNfNfnnnnNfnNfnnnsnsn-3' (SEQ ID NO: 13966), modification pattern 8AS: 5'-nsNfsnnnnnnnnnnNf nnnnnsnsn-3' (SEQ ID NO: 13967), or modification pattern 9AS: 5'-nsNfsnnnNfnnnnnnnNfnNfnNfnsnsn-3' (SEQ ID NO: 13968); wherein "Nf" is a 2' fluoro-modified nucleoside, "n" is a 2' O-methyl modified nucleoside, and "s" is a phosphorothioate linkage.

VII. Examples

The following examples are included for illustrative purposes only and are not intended to limit the scope of the invention.

Example 1: Loss of Function Variants in ANGPTL4 Are Associated with Decreased Risk of Cardiovascular and Metabolic Disease Approximately 30,000,000 imputed variants were analyzed in 375,000 individuals from the UK Biobank cohort for associations with cardiometabolic traits including circulating triglyceride levels, hyperlipidemia, chronic ischemic heart disease, myocardial infarction, Type 2 diabetes, and lipid-lowering and diabetes medication use. Additionally, rare loss of function variants were evaluated in a gene burden test in a subset of 45,000 individuals from the UK Biobank cohort with available exome sequencing data. Case counts in the full and exome-sequenced cohorts are shown in Table 2.

TABLE 2

Case and Value Counts for Tested Cardiometabolic Traits

| Trait | Imputed Genotypes Cases/Counts | Exome Sequencing Cases/Counts |
|---|---|---|
| Hyperlipidemia | 80,196 | 10,112 |
| Chronic ischemic heart disease | 26,771 | 3,135 |
| Angina pectoris | 22,200 | 2,685 |
| Myocardial Infarction | 15,250 | 1,616 |
| Type 2 diabetes mellitus | 20,663 | 2,512 |
| Medication-simvastatin | 42,197 | 5,404 |
| Medication-metformin | 9,262 | 1,184 |
| Family history of heart disease | 162,657 | 20,211 |
| Family history of diabetes | 76,202 | 9,845 |
| Blood Triglycerides | 356,875 | 43,055 |
| Blood HDL | 327,461 | 40,600 |

Protective associations were observed between a low-frequency and a rare missense variant (rs116843064; MAF=0.02 and rs140744493; MAF=0.003) within ANGPTL4 and cardiometabolic traits (see Table 3). The major allele (chr19-8429323-G, hg19) of the rs116843064 variant encodes for a glutamic acid residue and the minor allele (chr19-8429323-A, hg19) a lysine at amino acid position 40 of the full length ANGPTL4 protein (Glu40Lys; E40K). A lysine at position 40 reduces the inhibition of LPL by ANGPTL4; rs116843064 is thus a loss of function variant. The major allele (chr19-8436373-C, hg19) of the rs140744493 variant encodes for an arginine residue and the minor allele (chr19-8436373-T, hg19) a cysteine at amino acid position 336 of the full length ANGPTL4 protein (Arg336Cys; R336C). A cysteine at position 336 impairs cellular secretion of ANGPTL4; rs140744493 is thus also a loss of function variant. Carriers of the minor allele of both of these variants had a reduced risk of a range of cardiometabolic diseases, as well as reduced circulating triglycerides ($p=2.35\times10^{-145}$; beta=−0.048 and $p=2.64\times10^{-4}$; beta=−0.018 for rs116843064 and rs140744493, respectively) and increased high density lipoprotein levels ($p=2.35\times10^{-145}$; beta=−0.048 and $p=2.64\times10^{-4}$; beta= −0.018 for rs116843064 and rs140744493, respectively). Accordingly, in some cases therapeutic inhibition or modulation of ANGPTL4 may be an effective genetically-informed method of treatment for cardiovascular and metabolic disease.

TABLE 3

Association of ANGPTL4 Missense Variants with Cardiometabolic Traits

| Trait | rs116843064 (E40K) | | rs140744493 (R336C) | |
|---|---|---|---|---|
| | Effect Size | P | Effect Size | P |
| Hyperlipidemia | 0.87 (OR) | 2.04E−10 | NS | NS |
| Chronic ischemic heart disease | 0.84 (OR) | 1.03E−06 | NS | NS |
| Angina pectoris | 0.85 (OR) | 1.59E−05 | 0.81 (OR) | 0.04 |
| Myocardial Infarction | 0.85 (OR) | 4.53E−04 | NS | NS |
| Type 2 diabetes mellitus | 0.88 (OR) | 7.31E−04 | NS | NS |
| Medication-simvastatin | 0.91 (OR) | 1.13E−03 | 0.83 (OR) | 0.01 |
| Medication-metformin | 0.79 (OR) | 9.11E−05 | NS | NS |
| Family history of heart disease | 0.95 (OR) | 5.55E−03 | 0.91 (OR) | 0.04 |
| Family history of diabetes | 0.94 (OR) | 2.20E−03 | NS | NS |
| Blood Triglycerides | −0.048 (beta) | 2.35E−145 | −0.018 (beta) | 2.13E−04 |
| Blood HDL | 0.023 (beta) | 3.15E−115 | 0.011 (beta) | 9.70E−06 |

NS = Not Significant,
OR = Odds Ratio

Using the subset of individuals with available exome sequencing data (approximately 45,000 of the 375,000 individuals), a gene burden test was applied to assess the association of ANGPTL4 loss of function variants on cardiometabolic traits. Gene burden tests are used to aggregate rare variants in a gene by functional class that are too rare to be tested individually. In total, 17 rare predicted loss of function variants (frameshift, stop gained and splice donor/acceptor variants) in 72 total carriers were tested. Individuals carrying predicted ANGPTL4 loss of function variants had significantly lower triglyceride levels when compared to non-carriers (p=2.64E-4; beta=−0.097). These results are directionally consistent with the results obtained in the larger cohort for the rs116843064 and rs140744493 inactivating missense variants, and further confirm that ANGPTL4 loss of function results in lower circulating triglyceride levels.

Example 2: Bioinformatic Selection of Sequences in Order to Identify Therapeutic siRNAs to Downmodulate Expression of the ANGPTL4 mRNA Screening sets were defined based on bioinformatic analysis. Therapeutic siRNAs were designed to target human ANGPTL4, and the ANGPTL4 sequence of at least one toxicology-relevant species, in this case, the non-human primates (NHP) rhesus and cynomolgus monkeys. Drivers for the design of the screening set were predicted specificity of the siRNAs against the transcriptome of the relevant species as well as cross-reactivity between species. Predicted specificity in human, rhesus monkey, cynomolgus monkey, mouse and rat was determined for sense (S) and antisense (AS) strands. These were assigned a "specificity score" which considers the likelihood of unintended downregulation of any other transcript by full or partial complementarity of an siRNA strand (up to 4 mismatches within positions 2-18) as well as the number and positions of mismatches. Thus, off-target(s) for antisense and sense strands of each siRNA were identified. In addition, the number of potential off-targets was used as an additional specificity factor in the specificity score. As identified, siRNAs with high specificity and a low number of predicted off-targets provide a benefit of increased targeting specificity.

In addition to selecting siRNA sequences with high sequence specificity to ANGPTL4 mRNA, siRNA sequences within the seed region were analyzed for similarity to seed regions of known miRNAs. siRNAs can function in a miRNA like manner via base-pairing with complementary sequences within the 3'-UTR of mRNA molecules. The complementarity typically encompasses the 5'-bases at positions 2-7 of the miRNA (seed region). To circumvent siRNAs to act via functional miRNA binding sites, siRNA strands containing natural miRNA seed regions were avoided. Seed regions identified in miRNAs from human, mouse, rat, rhesus monkey, dog, rabbit and pig are referred to as "conserved". Combining the "specificity score" with miRNA seed analysis yielded a "specificity category". This is divided into categories 1-4, with 1 having the highest specificity and 4 having the lowest specificity. Each strand of the siRNA is assigned to a specificity category.

Species cross-reactivity was assessed for human, cynomolgus monkey, rhesus monkey, mouse and rat. The analysis was based on a canonical siRNA design using 19 bases and 17 bases (without considering positions 1 and 19) for cross-reactivity. Full match as well as single mismatch analyses were included.

Analysis of the human Single Nucleotide Polymorphism (SNP) database (NCBI-DB-SNP) to identify siRNAs targeting regions with known SNPs was also carried out to identify siRNAs that may be non-functional in individuals containing the SNP. Information regarding the positions of SNPs within the target sequence as well as minor allele frequency (MAF) in case data was obtained in this analysis.

Initial analysis of the relevant ANGPTL4 mRNA sequence revealed few sequences that fulfil the specificity parameters and at the same time target ANGPTL4 mRNA in all of the analyzed relevant species. Therefore, it was decided to design independent screening subsets for the therapeutic siRNAs.

The siRNAs in these subsets recognize the human ANGPTL4 sequence, as a human cell culture system is selected for determination of in vitro activity. Therefore, the siRNAs in these subsets can be used to target human ANGPTL4 in a therapeutic setting.

The number of siRNAs that were derived from human ANGPTL4 mRNA (NM_139314.3) without consideration of specificity or species cross-reactivity was 1,854 (antisense and sense strand sequences included in SEQ ID NOS: 1-3708).

Prioritizing sequences for target specificity, species cross-reactivity, miRNA seed region sequences and SNPs as described above yields subset A. The siRNAs in subset A are included in Table 4.

TABLE 4

Subset A

| siRNA Name | Sense Strand Sequence- SEQ ID NO: | Antisense Strand Sequence- SEQ ID NO: |
|---|---|---|
| siRNA 32 | 32 | 1886 |
| siRNA 33 | 33 | 1887 |
| siRNA 34 | 34 | 1888 |
| siRNA 35 | 35 | 1889 |
| siRNA 36 | 36 | 1890 |
| siRNA 56 | 56 | 1910 |
| siRNA 57 | 57 | 1911 |
| siRNA 58 | 58 | 1912 |
| siRNA 59 | 59 | 1913 |
| siRNA 61 | 61 | 1915 |
| siRNA 62 | 62 | 1916 |
| siRNA 63 | 63 | 1917 |
| siRNA 64 | 64 | 1918 |
| siRNA 79 | 79 | 1933 |
| siRNA 80 | 80 | 1934 |
| siRNA 84 | 84 | 1938 |
| siRNA 111 | 111 | 1965 |
| siRNA 112 | 112 | 1966 |
| siRNA 116 | 116 | 1970 |
| siRNA 117 | 117 | 1971 |
| siRNA 118 | 118 | 1972 |
| siRNA 119 | 119 | 1973 |
| siRNA 120 | 120 | 1974 |
| siRNA 121 | 121 | 1975 |
| siRNA 125 | 125 | 1979 |
| siRNA 126 | 126 | 1980 |
| siRNA 127 | 127 | 1981 |
| siRNA 128 | 128 | 1982 |
| siRNA 129 | 129 | 1983 |
| siRNA 149 | 149 | 2003 |
| siRNA 150 | 150 | 2004 |
| siRNA 152 | 152 | 2006 |
| siRNA 153 | 153 | 2007 |
| siRNA 154 | 154 | 2008 |
| siRNA 157 | 157 | 2011 |
| siRNA 158 | 158 | 2012 |
| siRNA 159 | 159 | 2013 |
| siRNA 161 | 161 | 2015 |
| siRNA 164 | 164 | 2018 |
| siRNA 165 | 165 | 2019 |
| siRNA 166 | 166 | 2020 |
| siRNA 167 | 167 | 2021 |
| siRNA 168 | 168 | 2022 |
| siRNA 169 | 169 | 2023 |
| siRNA 172 | 172 | 2026 |
| siRNA 174 | 174 | 2028 |
| siRNA 175 | 175 | 2029 |
| siRNA 177 | 177 | 2031 |
| siRNA 196 | 196 | 2050 |
| siRNA 198 | 198 | 2052 |
| siRNA 199 | 199 | 2053 |
| siRNA 210 | 210 | 2064 |
| siRNA 211 | 211 | 2065 |
| siRNA 212 | 212 | 2066 |
| siRNA 214 | 214 | 2068 |
| siRNA 215 | 215 | 2069 |
| siRNA 216 | 216 | 2070 |
| siRNA 217 | 217 | 2071 |
| siRNA 218 | 218 | 2072 |
| siRNA 219 | 219 | 2073 |
| siRNA 221 | 221 | 2075 |
| siRNA 222 | 222 | 2076 |
| siRNA 223 | 223 | 2077 |
| siRNA 228 | 228 | 2082 |
| siRNA 230 | 230 | 2084 |
| siRNA 231 | 231 | 2085 |
| siRNA 240 | 240 | 2094 |
| siRNA 241 | 241 | 2095 |
| siRNA 245 | 245 | 2099 |
| siRNA 246 | 246 | 2100 |
| siRNA 250 | 250 | 2104 |
| siRNA 252 | 252 | 2106 |
| siRNA 253 | 253 | 2107 |
| siRNA 254 | 254 | 2108 |
| siRNA 255 | 255 | 2109 |
| siRNA 260 | 260 | 2114 |
| siRNA 261 | 261 | 2115 |
| siRNA 262 | 262 | 2116 |
| siRNA 263 | 263 | 2117 |
| siRNA 265 | 265 | 2119 |
| siRNA 266 | 266 | 2120 |
| siRNA 271 | 271 | 2125 |
| siRNA 272 | 272 | 2126 |
| siRNA 274 | 274 | 2128 |
| siRNA 280 | 280 | 2134 |
| siRNA 282 | 282 | 2136 |
| siRNA 289 | 289 | 2143 |
| siRNA 290 | 290 | 2144 |
| siRNA 291 | 291 | 2145 |
| siRNA 292 | 292 | 2146 |
| siRNA 293 | 293 | 2147 |
| siRNA 299 | 299 | 2153 |
| siRNA 304 | 304 | 2158 |
| siRNA 321 | 321 | 2175 |
| siRNA 323 | 323 | 2177 |
| siRNA 325 | 325 | 2179 |
| siRNA 326 | 326 | 2180 |
| siRNA 328 | 328 | 2182 |
| siRNA 329 | 329 | 2183 |
| siRNA 330 | 330 | 2184 |
| siRNA 331 | 331 | 2185 |
| siRNA 332 | 332 | 2186 |
| siRNA 333 | 333 | 2187 |
| siRNA 334 | 334 | 2188 |
| siRNA 335 | 335 | 2189 |
| siRNA 337 | 337 | 2191 |
| siRNA 338 | 338 | 2192 |
| siRNA 339 | 339 | 2193 |
| siRNA 342 | 342 | 2196 |
| siRNA 347 | 347 | 2201 |
| siRNA 349 | 349 | 2203 |
| siRNA 350 | 350 | 2204 |
| siRNA 352 | 352 | 2206 |
| siRNA 353 | 353 | 2207 |
| siRNA 356 | 356 | 2210 |
| siRNA 377 | 377 | 2231 |
| siRNA 380 | 380 | 2234 |
| siRNA 382 | 382 | 2236 |
| siRNA 386 | 386 | 2240 |
| siRNA 388 | 388 | 2242 |
| siRNA 391 | 391 | 2245 |
| siRNA 392 | 392 | 2246 |
| siRNA 393 | 393 | 2247 |
| siRNA 394 | 394 | 2248 |
| siRNA 397 | 397 | 2251 |
| siRNA 398 | 398 | 2252 |
| siRNA 399 | 399 | 2253 |
| siRNA 402 | 402 | 2256 |
| siRNA 404 | 404 | 2258 |
| siRNA 405 | 405 | 2259 |
| siRNA 411 | 411 | 2265 |
| siRNA 412 | 412 | 2266 |
| siRNA 413 | 413 | 2267 |
| siRNA 414 | 414 | 2268 |
| siRNA 415 | 415 | 2269 |
| siRNA 417 | 417 | 2271 |
| siRNA 419 | 419 | 2273 |
| siRNA 420 | 420 | 2274 |
| siRNA 421 | 421 | 2275 |
| siRNA 422 | 422 | 2276 |
| siRNA 423 | 423 | 2277 |
| siRNA 424 | 424 | 2278 |
| siRNA 425 | 425 | 2279 |
| siRNA 426 | 426 | 2280 |
| siRNA 427 | 427 | 2281 |
| siRNA 428 | 428 | 2282 |
| siRNA 429 | 429 | 2283 |
| siRNA 430 | 430 | 2284 |

TABLE 4-continued

Subset A

| siRNA Name | Sense Strand Sequence- SEQ ID NO: | Antisense Strand Sequence- SEQ ID NO: |
| --- | --- | --- |
| siRNA 431 | 431 | 2285 |
| siRNA 435 | 435 | 2289 |
| siRNA 481 | 481 | 2335 |
| siRNA 484 | 484 | 2338 |
| siRNA 506 | 506 | 2360 |
| siRNA 509 | 509 | 2363 |
| siRNA 517 | 517 | 2371 |
| siRNA 519 | 519 | 2373 |
| siRNA 520 | 520 | 2374 |
| siRNA 565 | 565 | 2419 |
| siRNA 570 | 570 | 2424 |
| siRNA 571 | 571 | 2425 |
| siRNA 572 | 572 | 2426 |
| siRNA 589 | 589 | 2443 |
| siRNA 607 | 607 | 2461 |
| siRNA 608 | 608 | 2462 |
| siRNA 610 | 610 | 2464 |
| siRNA 611 | 611 | 2465 |
| siRNA 612 | 612 | 2466 |
| siRNA 616 | 616 | 2470 |
| siRNA 617 | 617 | 2471 |
| siRNA 620 | 620 | 2474 |
| siRNA 623 | 623 | 2477 |
| siRNA 635 | 635 | 2489 |
| siRNA 637 | 637 | 2491 |
| siRNA 640 | 640 | 2494 |
| siRNA 643 | 643 | 2497 |
| siRNA 653 | 653 | 2507 |
| siRNA 672 | 672 | 2526 |
| siRNA 673 | 673 | 2527 |
| siRNA 674 | 674 | 2528 |
| siRNA 675 | 675 | 2529 |
| siRNA 676 | 676 | 2530 |
| siRNA 677 | 677 | 2531 |
| siRNA 678 | 678 | 2532 |
| siRNA 679 | 679 | 2533 |
| siRNA 681 | 681 | 2535 |
| siRNA 682 | 682 | 2536 |
| siRNA 683 | 683 | 2537 |
| siRNA 684 | 684 | 2538 |
| siRNA 686 | 686 | 2540 |
| siRNA 687 | 687 | 2541 |
| siRNA 689 | 689 | 2543 |
| siRNA 692 | 692 | 2546 |
| siRNA 695 | 695 | 2549 |
| siRNA 830 | 830 | 2684 |
| siRNA 834 | 834 | 2688 |
| siRNA 841 | 841 | 2695 |
| siRNA 842 | 842 | 2696 |
| siRNA 843 | 843 | 2697 |
| siRNA 844 | 844 | 2698 |
| siRNA 850 | 850 | 2704 |
| siRNA 851 | 851 | 2705 |
| siRNA 852 | 852 | 2706 |
| siRNA 853 | 853 | 2707 |
| siRNA 854 | 854 | 2708 |
| siRNA 856 | 856 | 2710 |
| siRNA 857 | 857 | 2711 |
| siRNA 859 | 859 | 2713 |
| siRNA 866 | 866 | 2720 |
| siRNA 868 | 868 | 2722 |
| siRNA 871 | 871 | 2725 |
| siRNA 872 | 872 | 2726 |
| siRNA 876 | 876 | 2730 |
| siRNA 887 | 887 | 2741 |
| siRNA 888 | 888 | 2742 |
| siRNA 890 | 890 | 2744 |
| siRNA 892 | 892 | 2746 |
| siRNA 893 | 893 | 2747 |
| siRNA 894 | 894 | 2748 |
| siRNA 897 | 897 | 2751 |
| siRNA 900 | 900 | 2754 |
| siRNA 902 | 902 | 2756 |
| siRNA 907 | 907 | 2761 |
| siRNA 911 | 911 | 2765 |
| siRNA 912 | 912 | 2766 |
| siRNA 913 | 913 | 2767 |
| siRNA 914 | 914 | 2768 |
| siRNA 915 | 915 | 2769 |
| siRNA 916 | 916 | 2770 |
| siRNA 917 | 917 | 2771 |
| siRNA 918 | 918 | 2772 |
| siRNA 919 | 919 | 2773 |
| siRNA 920 | 920 | 2774 |
| siRNA 921 | 921 | 2775 |
| siRNA 922 | 922 | 2776 |
| siRNA 925 | 925 | 2779 |
| siRNA 945 | 945 | 2799 |
| siRNA 968 | 968 | 2822 |
| siRNA 1001 | 1001 | 2855 |
| siRNA 1002 | 1002 | 2856 |
| siRNA 1005 | 1005 | 2859 |
| siRNA 1006 | 1006 | 2860 |
| siRNA 1009 | 1009 | 2863 |
| siRNA 1010 | 1010 | 2864 |
| siRNA 1011 | 1011 | 2865 |
| siRNA 1013 | 1013 | 2867 |
| siRNA 1028 | 1028 | 2882 |
| siRNA 1032 | 1032 | 2886 |
| siRNA 1037 | 1037 | 2891 |
| siRNA 1052 | 1052 | 2906 |
| siRNA 1053 | 1053 | 2907 |
| siRNA 1054 | 1054 | 2908 |
| siRNA 1055 | 1055 | 2909 |
| siRNA 1057 | 1057 | 2911 |
| siRNA 1058 | 1058 | 2912 |
| siRNA 1064 | 1064 | 2918 |
| siRNA 1112 | 1112 | 2966 |
| siRNA 1122 | 1122 | 2976 |
| siRNA 1124 | 1124 | 2978 |
| siRNA 1126 | 1126 | 2980 |
| siRNA 1127 | 1127 | 2981 |
| siRNA 1133 | 1133 | 2987 |
| siRNA 1134 | 1134 | 2988 |
| siRNA 1136 | 1136 | 2990 |
| siRNA 1137 | 1137 | 2991 |
| siRNA 1147 | 1147 | 3001 |
| siRNA 1148 | 1148 | 3002 |
| siRNA 1149 | 1149 | 3003 |
| siRNA 1151 | 1151 | 3005 |
| siRNA 1153 | 1153 | 3007 |
| siRNA 1154 | 1154 | 3008 |
| siRNA 1155 | 1155 | 3009 |
| siRNA 1157 | 1157 | 3011 |
| siRNA 1158 | 1158 | 3012 |
| siRNA 1161 | 1161 | 3015 |
| siRNA 1162 | 1162 | 3016 |
| siRNA 1163 | 1163 | 3017 |
| siRNA 1164 | 1164 | 3018 |
| siRNA 1165 | 1165 | 3019 |
| siRNA 1166 | 1166 | 3020 |
| siRNA 1171 | 1171 | 3025 |
| siRNA 1172 | 1172 | 3026 |
| siRNA 1175 | 1175 | 3029 |
| siRNA 1181 | 1181 | 3035 |
| siRNA 1182 | 1182 | 3036 |
| siRNA 1184 | 1184 | 3038 |
| siRNA 1248 | 1248 | 3102 |
| siRNA 1249 | 1249 | 3103 |
| siRNA 1252 | 1252 | 3106 |
| siRNA 1253 | 1253 | 3107 |
| siRNA 1259 | 1259 | 3113 |
| siRNA 1276 | 1276 | 3130 |
| siRNA 1285 | 1285 | 3139 |
| siRNA 1310 | 1310 | 3164 |
| siRNA 1315 | 1315 | 3169 |
| siRNA 1338 | 1338 | 3192 |
| siRNA 1343 | 1343 | 3197 |

TABLE 4-continued

Subset A

| siRNA Name | Sense Strand Sequence- SEQ ID NO: | Antisense Strand Sequence- SEQ ID NO: |
|---|---|---|
| siRNA 1347 | 1347 | 3201 |
| siRNA 1348 | 1348 | 3202 |
| siRNA 1349 | 1349 | 3203 |
| siRNA 1350 | 1350 | 3204 |
| siRNA 1351 | 1351 | 3205 |
| siRNA 1352 | 1352 | 3206 |
| siRNA 1378 | 1378 | 3232 |
| siRNA 1405 | 1405 | 3259 |
| siRNA 1407 | 1407 | 3261 |
| siRNA 1413 | 1413 | 3267 |
| siRNA 1414 | 1414 | 3268 |
| siRNA 1415 | 1415 | 3269 |
| siRNA 1416 | 1416 | 3270 |
| siRNA 1417 | 1417 | 3271 |
| siRNA 1418 | 1418 | 3272 |
| siRNA 1429 | 1429 | 3283 |
| siRNA 1430 | 1430 | 3284 |
| siRNA 1448 | 1448 | 3302 |
| siRNA 1477 | 1477 | 3331 |
| siRNA 1487 | 1487 | 3341 |
| siRNA 1488 | 1488 | 3342 |
| siRNA 1489 | 1489 | 3343 |
| siRNA 1493 | 1493 | 3347 |
| siRNA 1494 | 1494 | 3348 |
| siRNA 1519 | 1519 | 3373 |
| siRNA 1523 | 1523 | 3377 |
| siRNA 1538 | 1538 | 3392 |
| siRNA 1556 | 1556 | 3410 |
| siRNA 1561 | 1561 | 3415 |
| siRNA 1563 | 1563 | 3417 |
| siRNA 1564 | 1564 | 3418 |
| siRNA 1565 | 1565 | 3419 |
| siRNA 1570 | 1570 | 3424 |
| siRNA 1571 | 1571 | 3425 |
| siRNA 1572 | 1572 | 3426 |
| siRNA 1580 | 1580 | 3434 |
| siRNA 1581 | 1581 | 3435 |
| siRNA 1589 | 1589 | 3443 |
| siRNA 1597 | 1597 | 3451 |
| siRNA 1598 | 1598 | 3452 |
| siRNA 1601 | 1601 | 3455 |
| siRNA 1602 | 1602 | 3456 |
| siRNA 1603 | 1603 | 3457 |
| siRNA 1604 | 1604 | 3458 |
| siRNA 1605 | 1605 | 3459 |
| siRNA 1606 | 1606 | 3460 |
| siRNA 1610 | 1610 | 3464 |
| siRNA 1611 | 1611 | 3465 |
| siRNA 1613 | 1613 | 3467 |
| siRNA 1614 | 1614 | 3468 |
| siRNA 1617 | 1617 | 3471 |
| siRNA 1693 | 1693 | 3547 |
| siRNA 1699 | 1699 | 3553 |
| siRNA 1701 | 1701 | 3555 |
| siRNA 1702 | 1702 | 3556 |
| siRNA 1703 | 1703 | 3557 |
| siRNA 1722 | 1722 | 3576 |
| siRNA 1740 | 1740 | 3594 |
| siRNA 1741 | 1741 | 3595 |
| siRNA 1742 | 1742 | 3596 |
| siRNA 1745 | 1745 | 3599 |
| siRNA 1747 | 1747 | 3601 |
| siRNA 1748 | 1748 | 3602 |
| siRNA 1749 | 1749 | 3603 |
| siRNA 1751 | 1751 | 3605 |
| siRNA 1754 | 1754 | 3608 |
| siRNA 1755 | 1755 | 3609 |
| siRNA 1779 | 1779 | 3633 |
| siRNA 1780 | 1780 | 3634 |
| siRNA 1784 | 1784 | 3638 |
| siRNA 1787 | 1787 | 3641 |
| siRNA 1788 | 1788 | 3642 |
| siRNA 1798 | 1798 | 3652 |
| siRNA 1799 | 1799 | 3653 |
| siRNA 1800 | 1800 | 3654 |
| siRNA 1801 | 1801 | 3655 |
| siRNA 1802 | 1802 | 3656 |
| siRNA 1803 | 1803 | 3657 |

Subset A includes 102 siRNA sequences that are cross-reactive with NHP ANGPTL4 mRNA (siRNAs 33, 34, 35, 36, 56, 121, 272, 280, 282, 289, 290, 291, 292, 293, 321, 323, 326, 328, 329, 330, 331, 332, 333, 334, 335, 337, 338, 339, 342, 347, 349, 411, 412, 430, 431, 435, 481, 484, 509, 517, 519, 520, 565, 620, 635, 637, 640, 830, 834, 841, 842, 843, 844, 850, 871, 872, 876, 887, 888, 894, 897, 902, 945, 1001, 1002, 1005, 1037, 1133, 1134, 1137, 1149, 1151, 1153, 1154, 1155, 1157, 1158, 1161, 1162, 1164, 1165, 1166, 1171, 1172, 1248, 1249, 1315, 1338, 1343, 1347, 1348, 1429, 1430, 1570, 1571, 1572, 1610, 1611, 1617, 1780, 1784, and 1787). The siRNAs in subset A that may be cross-reactive with NHP ANGPTL4 mRNA were tested in vitro (see, e.g., Table 5). In some cases, the sense strand of any of these siRNAs comprises modification pattern 1S. In some cases, the antisense strand of any of these siRNAs comprises modification pattern 1AS.

The siRNAs in subset A have the following characteristics:

Cross-reactivity: With 19mer in human ANGPTL4 mRNA, with 17mer/19mer in NHP ANGPTL4

Specificity category: For human and NHP: AS2 or better, SS3 or better miRNA seeds: AS+SS strand: seed region not conserved in human, mouse, and rat and not present in ≥4 species Off-target frequency: ≤20 human off-targets matched with 2 mismatches in antisense strand SNPs: siRNA target sites do not harbor SNPs with a MAF≥1% (pos. 2-18)

The siRNA sequences in subset A were selected for more stringent specificity to yield subset B. Subset B includes 323 siRNAs (siRNAs 32, 33, 34, 35, 36, 56, 57, 58, 59, 61, 62, 63, 64, 79, 80, 112, 116, 117, 118, 119, 120, 125, 126, 127, 128, 129, 149, 150, 152, 153, 157, 158, 159, 161, 164, 165, 166, 167, 168, 169, 172, 174, 175, 196, 199, 211, 212, 214, 215, 216, 217, 218, 219, 221, 222, 223, 228, 230, 231, 240, 241, 245, 246, 250, 252, 253, 254, 255, 260, 261, 262, 263, 265, 266, 271, 272, 274, 280, 289, 290, 291, 292, 293, 299, 304, 321, 323, 325, 326, 328, 329, 330, 331, 332, 333, 334, 335, 337, 338, 339, 342, 347, 349, 350, 352, 353, 356, 380, 382, 386, 388, 391, 392, 393, 394, 397, 398, 399, 402, 404, 405, 411, 412, 413, 414, 415, 420, 421, 422, 423, 424, 425, 426, 427, 428, 429, 430, 431, 435, 484, 517, 519, 520, 565, 570, 571, 572, 607, 608, 610, 611, 612, 616, 617, 620, 635, 637, 640, 672, 673, 674, 675, 676, 677, 678, 679, 681, 682, 683, 684, 686, 687, 689, 692, 695, 830, 841, 842, 843, 844, 850, 851, 852, 853, 854, 856, 857, 866, 868, 871, 872, 876, 887, 888, 890, 892, 893, 894, 902, 911, 912, 913, 914, 915, 916, 917, 918, 919, 920, 921, 922, 945, 1001, 1002, 1005, 1006, 1009, 1010, 1011, 1013, 1028, 1032, 1052, 1053, 1054, 1055, 1057, 1058, 1112, 1122, 1124, 1126, 1127, 1133, 1134, 1147, 1148, 1149, 1151, 1153, 1154, 1155, 1157, 1158, 1161, 1162, 1164, 1165, 1166, 1175, 1182, 1184, 1252, 1253, 1259, 1276, 1285, 1310, 1315, 1343, 1347, 1348, 1349, 1350, 1351, 1405, 1407, 1413, 1414, 1415, 1416, 1417, 1418, 1429, 1430, 1448, 1519, 1523, 1556, 1561, 1563, 1564, 1565, 1571, 1572, 1580, 1581, 1589, 1597, 1601, 1602, 1603, 1604, 1605, 1606, 1611, 1613, 1614, 1693, 1699, 1701, 1702, 1703, 1722, 1740, 1741, 1742, 1745, 1747, 1748, 1749, 1751, 1754, 1755, 1779, 1780, 1784, 1788, 1798, 1799, 1801, 1802, and 1803). This subset includes 85 siRNA sequences that are cross-reactive with NHP ANGPTL4 mRNA (siRNAs 33, 34, 35, 36, 56, 272, 280, 289, 290, 291, 292, 293, 321, 323, 326, 328, 329, 330, 331, 332, 333, 334, 335, 337, 338, 339, 342, 347, 349, 411, 412, 430, 431, 435, 484, 517, 519, 520, 565, 620, 635, 637, 640, 830, 841, 842, 843, 844, 850, 871, 872, 876, 887, 888, 894, 902, 945, 1001, 1002, 1005, 1133, 1134, 1149, 1151, 1153, 1154, 1155, 1157, 1158, 1161, 1162, 1164, 1165, 1166, 1315, 1343, 1347, 1348, 1429, 1430, 1571, 1572, 1611, 1780, and 1784).

The siRNAs in subset B have the following characteristics:
  Cross-reactivity: With 19mer in human ANGPTL4 mRNA, with 17mer/19mer in NHP ANGPTL4
  Specificity category: For human and NHP: AS2 or better, SS3 or better
  miRNA seeds: AS+SS strand: seed region not conserved in human, mouse, and rat and not present in >4 species
  Off-target frequency: ≤15 human off-targets matched with 2 mismatches in antisense strand
  SNPs: siRNA target sites do not harbor SNPs with a MAF≥1% (pos. 2-18)

The siRNA sequences in subset B were further selected for absence of seed regions in the AS strand that are identical to a seed region of known human miRNA to yield subset C. Subset C includes 183 siRNAs (siRNAs 32, 36, 56, 57, 58, 61, 62, 79, 80, 117, 119, 125, 126, 128, 149, 152, 157, 158, 159, 161, 165, 166, 167, 168, 169, 174, 196, 211, 212, 217, 218, 219, 230, 231, 245, 246, 253, 260, 261, 262, 271, 272, 280, 289, 291, 292, 293, 304, 321, 323, 325, 326, 328, 330, 331, 332, 333, 334, 337, 338, 342, 347, 349, 352, 353, 356, 380, 382, 386, 388, 391, 392, 394, 399, 413, 414, 415, 422, 423, 424, 425, 426, 435, 517, 519, 520, 565, 571, 607, 608, 612, 617, 620, 635, 640, 672, 673, 674, 675, 678, 679, 681, 683, 684, 687, 692, 842, 843, 850, 851, 854, 866, 868, 876, 892, 893, 902, 911, 912, 913, 914, 916, 919, 945, 1001, 1002, 1006, 1010, 1028, 1052, 1053, 1054, 1055, 1057, 1112, 1124, 1127, 1147, 1149, 1151, 1153, 1155, 1157, 1164, 1175, 1182, 1184, 1259, 1276, 1285, 1315, 1343, 1349, 1350, 1351, 1405, 1407, 1413, 1415, 1418, 1564, 1571, 1581, 1589, 1597, 1601, 1602, 1603, 1604, 1605, 1606, 1613, 1614, 1693, 1701, 1722, 1740, 1745, 1751, 1755, 1801, 1802, and 1803). This subset includes 47 siRNA sequences that are cross-reactive with NHP ANGPTL4 mRNA (siRNAs 36, 56, 272, 280, 289, 291, 292, 293, 321, 323, 326, 328, 330, 331, 332, 333, 334, 337, 338, 342, 347, 349, 435, 517, 519, 520, 565, 620, 635, 640, 842, 843, 850, 876, 902, 945, 1001, 1002, 1149, 1151, 1153, 1155, 1157, 1164, 1315, 1343, and 1571).

The siRNAs in subset C have the following characteristics:
  Cross-reactivity: With 19mer in human ANGPTL4 mRNA, with 17mer/19mer in NHP ANGPTL4
  Specificity category: For human and NHP: AS2 or better, SS3 or better
  miRNA seeds: AS+SS strand: seed region not conserved in human, mouse, and rat and not present in >4 species. AS strand: seed region not identical to seed region of known human miRNA
  Off-target frequency: ≤15 human off-targets matched with 2 mismatches by antisense strand
  SNPs: siRNA target sites do not harbor SNPs with a MAF≥1% (pos. 2-18)

The siRNA sequences in subset C were also selected for absence of seed regions in the AS or S strands that are identical to a seed region of known human miRNA to yield subset D. Subset D includes 114 siRNAs (siRNAs 32, 36, 56, 58, 61, 62, 80, 117, 119, 126, 152, 154, 157, 158, 159, 161, 166, 169, 174, 177, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 653, 672, 678, 679, 681, 683, 692, 842, 843, 851, 854, 859, 876, 892, 900, 913, 914, 919, 968, 1001, 1002, 1054, 1057, 1064, 1112, 1124, 1157, 1164, 1182, 1184, 1248, 1259, 1343, 1351, 1352, 1415, 1418, 1564, 1581, 1602, 1614, 1693, 1701, 1722, 1740, 1751, 1755, and 1787). This subset includes 26 siRNA sequences that are cross-reactive with NHP ANGPTL4 mRNA (siRNAs 36, 56, 272, 280, 289, 293, 328, 330, 331, 332, 333, 334, 337, 342, 347, 349, 435, 520, 842, 843, 876, 1001, 1002, 1157, 1164, and 1343).

The siRNAs in subset D have the following characteristics:
  Cross-reactivity: With 19mer in human ANGPTL4 mRNA, with 17mer/19mer in NHP ANGPTL4
  Specificity category: For human and NHP: AS2 or better, SS3 or better
  miRNA seeds: AS+SS strand: seed region not conserved in human, mouse, and rat and not present in >4 species. AS+SS strand: seed region not identical to seed region of known human miRNA
  Off-target frequency: ≤20 human off-targets matched with 2 mismatches by antisense strand
  SNPs: siRNA target sites do not harbor SNPs with a MAF≥1% (pos. 2-18)

The siRNA sequences in subset D were further selected for more stringent specificity to yield subset E. Subset E includes 104 siRNAs (siRNAs 32, 36, 56, 58, 61, 62, 80, 117, 119, 126, 152, 157, 158, 159, 161, 166, 169, 174, 196, 211, 212, 217, 218, 230, 231, 245, 253, 260, 261, 271, 272, 280, 289, 293, 304, 328, 330, 331, 332, 333, 334, 337, 342, 347, 349, 353, 356, 386, 388, 391, 392, 394, 414, 415, 422, 423, 424, 426, 435, 520, 571, 608, 612, 617, 672, 678, 679, 681, 683, 692, 842, 843, 851, 854, 876, 892, 913, 914, 919, 1001, 1002, 1054, 1057, 1112, 1124, 1157, 1164, 1182, 1184, 1259, 1343, 1351, 1415, 1418, 1564, 1581, 1602, 1614, 1693, 1701, 1722, 1740, 1751, and 1755). This set includes 26 siRNA sequences that are cross-reactive with NHP ANGPTL4 mRNA (siRNAs 36, 56, 272, 280, 289, 293, 328, 330, 331, 332, 333, 334, 337, 342, 347, 349, 435, 520, 842, 843, 876, 1001, 1002, 1157, 1164, and 1343).

The siRNAs in subset E have the following characteristics:
  Cross-reactivity: With 19mer in human ANGPTL4 mRNA, with 17mer/19mer in NHP ANGPTL4
  Specificity category: For human and NHP: AS2 or better, SS3 or better
  miRNA seeds: AS+SS strand: seed region not conserved in human, mouse, and rat and not present in >4 species. AS+SS strand: seed region not identical to seed region of known human miRNA Off-target frequency: ≤15 human off-targets matched with 2 mismatches by antisense strand SNPs: siRNA target sites do not harbor SNPs with a MAF≥1% (pos. 2-18)

The siRNA sequences targeting ANGPTL4 can also be selected using other criteria. Subset F includes 115 siRNAs (siRNAs 32, 57, 119, 120, 125, 126, 127, 128, 164, 165, 166, 167, 168, 169, 174, 175, 176, 177, 199, 250, 252, 255, 260, 261, 262, 263, 353, 356, 363, 372, 403, 404, 412, 413, 417, 423, 424, 425, 426, 427, 428, 429, 565, 570, 571, 572, 589, 607, 608, 610, 611, 612, 672, 673, 674, 675, 676, 677, 678, 679, 689, 695, 759, 801, 851, 852, 853, 854, 857, 859, 866, 868, 907, 911, 912, 913, 914, 915, 918, 919, 972, 1006, 1009, 1010, 1011, 1013, 1028, 1034, 1037, 1048, 1126, 1276, 1285, 1349, 1489, 1490, 1564, 1565, 1580, 1581, 1589, 1597, 1598, 1601, 1602, 1603, 1604, 1605, 1606, 1610, 1701, 1702, 1789, 1840, and 1842).

The siRNAs in subset F met the following criteria:

Cross-reactivity: With 19mer in human ANGPTL4 mRNA. One or fewer mismatches with 19mer in either rhesus or cynomolgus monkey.

Specificity category: For human: AS2 or better, SS3 or better. For NHP: AS3 or better, SS3 or better miRNA seeds: AS+SS strand: seed region conserved in <4 species (out of 7). AS and SS strand: seed region not conserved between human, mouse and rat Off-target frequency: For human: no perfect match or single mismatches. For NHP: no perfect match SNPs: siRNA target sites do not harbor SNPs with a MAF≥1% (pos. 2-18)

Subset G includes 20 siRNAs (siRNAs 32, 570, 571, 572, 589, 607, 759, 801, 1276, 1285, 1489, 1490, 1564, 1580, 1581, 1589, 1597, 1702, 1840, and 1842). The siRNAs in subset G include siRNAs from subset F that were tested in vitro (see, e.g., Table 6). In some cases, the sense strand of any of the siRNAs of subset G comprises modification pattern 2S. In some cases, the antisense strand of any of the siRNAs of subset G comprises modification pattern 3AS. The siRNAs in subset G may comprise any other modification pattern(s).

Any siRNA among any of subsets A-G may comprise any modification pattern described herein. If a sequence is a different number of nucleotides in length than a modification pattern, the modification pattern may still be used with the appropriate number of additional nucleotides added 5' or 3' to match the number of nucleotides in the modification pattern. For example, if a sense or antisense strand of the siRNA among any of subsets A-G comprises 19 nucleotides, and a modification pattern comprises 21 nucleotides, UU may be added onto the 5' end of the sense or antisense strand.

Example 3: Chemically Modified ANGPTL4 siRNAs

The siRNAs targeting ANGPTL4 can be synthesized with chemical modifications with the sense strand having modification pattern 1S (SEQ ID NO: 13954) and the antisense strand having modification pattern 1AS (SEQ ID NO: 13960). In addition, adenosine can be placed at position 19 in the sense strand and uridine at position 1 in the antisense strand.

The siRNAs targeting ANGPTL4 can also be synthesized with chemical modifications with the sense strand having modification pattern 2S (SEQ ID NO: 13955) and the antisense strand having modification pattern 3AS (SEQ ID NO: 13962). In addition, adenosine can be placed at position 19 in the sense strand and uridine at position 1 in the antisense strand.

The siRNAs targeting ANGPTL4 can also be synthesized with chemical modifications with the sense strand having modification pattern 2S (SEQ ID NO: 13955) and the antisense strand having modification pattern 9AS (SEQ ID NO: 13968). In addition, adenosine can be placed at position 19 in the sense strand and uridine at position 1 in the antisense strand.

The siRNAs targeting ANGPTL4 can also be synthesized with chemical modifications with the sense strand having modification pattern 3S (SEQ ID NO: 13954) and the antisense strand having modification pattern 3AS (SEQ ID NO: 13962). In addition, adenosine can be placed at position 19 in the sense strand and uridine at position 1 in the antisense strand.

Example 4: Screening ANGPTL4 siRNAs for Activity in Cells in Culture

Chemically modified ANGPTL4 siRNAs cross reactive for human and non-human primate were assayed for ANGPTL4 mRNA knockdown activity in cells in culture. U-138 MG (ATCC® HTB-16) cells were seeded in 96-well tissue culture plates at a cell density of 7,500 cells per well in EMEM (BD Biosciences Catalog No. 670086) supplemented with 10% fetal bovine serum and incubated overnight in a water-jacketed, humidified incubator at 37° C. in an atmosphere composed of air plus 5% carbon dioxide. The ANGPTL4 siRNAs were individually transfected into U-138 MG cells in duplicate wells at 10 nM final concentration using 0.3 μL Lipofectamine RNAiMax (Fisher) per well. Silencer Select Negative Control #1 (ThermoFisher, Catalog #4390843) was transfected at 10 nM final concentration as a control. After incubation for 48 hours at 37° C., total RNA was harvested from each well and cDNA prepared using TaqMan® Fast Advanced Cells-to-CT™ Kit (ThermoFisher, Catalog #A35374) according to the manufacturer's instructions. The level of ANGPTL4 mRNA from each well was measured in triplicate by real-time qPCR on an Applied Biosystems 7500 Fast Real-Time PCR machine using TaqMan Gene Expression Assay for human ANGPTL4 (ThermoFisher, assay #Hs01101127 m1). The level of PPIA mRNA was measured using TaqMan Gene Expression Assay (ThermoFisher, assay #Hs99999904 ml) and used to determine relative ANGPTL4 mRNA levels in each well using the delta-delta Ct method. All data were normalized to relative ANGPTL4 mRNA levels in untreated U-138 MG cells. A subset of the siRNAs were also tested at 1 nM concentration. Results are shown in Table 5 and Table 6. The siRNAs in Table 5 (ETD00646-ETD00747) each comprised a sense strand having modification pattern 1S, and an sense strand having modification pattern 1AS. The siRNAs in Table 6 (ETD00915-ETD00934) each comprised a sense strand having modification pattern 2S, and an sense strand having modification pattern 3AS.

TABLE 5

Knockdown Activity of ANGPTL4-Specific siRNAs at 1 nM and 10 nM in Human U-138 MG cells

| siRNA name | Sense Strand SEQ ID NO: | Antisense Strand SEQ ID NO: | Relative ANGPTL4 mRNA Level | |
|---|---|---|---|---|
| | | | 1 nM siRNA | 10 nM siRNA |
| Untreated Cells | — | — | 1.00 | 1.00 |
| Negative Control siRNA | — | — | 1.15 | 1.14 |
| ETD00646 | 14012 | 14167 | ND | 0.72 |
| ETD00647 | 14013 | 14168 | ND | 0.97 |
| ETD00648 | 14014 | 14169 | ND | 0.84 |
| ETD00649 | 14015 | 14170 | 0.94 | 0.69 |
| ETD00650 | 14016 | 14171 | ND | 2.08 |
| ETD00651 | 14017 | 14172 | 0.99 | 0.71 |
| ETD00652 | 14018 | 14173 | ND | 1.06 |
| ETD00653 | 14019 | 14174 | 1.03 | 0.63 |
| ETD00654 | 14020 | 14175 | 1.18 | 0.68 |
| ETD00655 | 14021 | 14176 | 1.05 | 0.65 |
| ETD00656 | 14022 | 14177 | ND | 0.86 |
| ETD00657 | 14023 | 14178 | ND | 0.96 |
| ETD00658 | 14024 | 14179 | ND | 0.87 |
| ETD00659 | 14025 | 14180 | ND | 1.02 |
| ETD00660 | 14026 | 14181 | ND | 0.84 |
| ETD00661 | 14027 | 14182 | ND | 0.84 |
| ETD00662 | 14028 | 14183 | ND | 0.82 |
| ETD00663 | 14029 | 14184 | ND | 0.94 |
| ETD00664 | 14030 | 14185 | ND | 0.97 |
| ETD00665 | 14031 | 14186 | ND | 1.22 |
| ETD00666 | 14032 | 14187 | ND | 1.24 |
| ETD00667 | 14033 | 14188 | ND | 0.88 |
| ETD00668 | 14034 | 14189 | ND | 1.00 |
| ETD00669 | 14035 | 14190 | 1.05 | 0.68 |
| ETD00670 | 14036 | 14191 | ND | 0.93 |
| ETD00671 | 14037 | 14192 | ND | 1.59 |
| ETD00672 | 14038 | 14193 | ND | 1.41 |
| ETD00673 | 14039 | 14194 | ND | 1.80 |
| ETD00674 | 14040 | 14195 | ND | 1.87 |
| ETD00675 | 14041 | 14196 | ND | 1.04 |
| ETD00676 | 14042 | 14197 | ND | 1.28 |
| ETD00677 | 14043 | 14198 | ND | 1.39 |
| ETD00678 | 14044 | 14199 | ND | 1.49 |
| ETD00679 | 14045 | 14200 | ND | 1.28 |
| ETD00680 | 14046 | 14201 | ND | 1.52 |
| ETD00681 | 14047 | 14202 | ND | 2.12 |
| ETD00682 | 14048 | 14203 | ND | 0.91 |
| ETD00683 | 14049 | 14204 | 1.06 | 0.47 |
| ETD00684 | 14050 | 14205 | 0.88 | 0.63 |
| ETD00685 | 14051 | 14206 | ND | 1.02 |
| ETD00686 | 14052 | 14207 | 0.79 | 0.66 |
| ETD00687 | 14053 | 14208 | ND | 0.91 |
| ETD00688 | 14054 | 14209 | ND | 0.84 |
| ETD00689 | 14055 | 14210 | 1.01 | 0.51 |
| ETD00690 | 14056 | 14211 | ND | 1.29 |
| ETD00691 | 14057 | 14212 | ND | 0.80 |
| ETD00692 | 14058 | 14213 | ND | 0.78 |
| ETD00693 | 14059 | 14214 | ND | 1.09 |
| ETD00694 | 14060 | 14215 | 1.16 | 0.58 |
| ETD00695 | 14061 | 14216 | ND | 1.79 |
| ETD00696 | 14062 | 14217 | ND | 1.55 |
| ETD00697 | 14063 | 14218 | ND | 1.42 |
| ETD00698 | 14064 | 14219 | ND | 1.83 |
| ETD00699 | 14065 | 14220 | ND | 1.10 |
| ETD00700 | 14066 | 14221 | ND | 1.33 |
| ETD00701 | 14067 | 14222 | ND | 1.13 |
| ETD00702 | 14068 | 14223 | ND | 0.85 |
| ETD00703 | 14069 | 14224 | ND | 1.26 |
| ETD00704 | 14070 | 14225 | ND | 1.14 |
| ETD00705 | 14071 | 14226 | ND | 1.72 |
| ETD00706 | 14072 | 14227 | ND | 1.63 |
| ETD00707 | 14073 | 14228 | ND | 0.92 |
| ETD00708 | 14074 | 14229 | ND | 1.69 |
| ETD00709 | 14075 | 14230 | 1.24 | 0.69 |
| ETD00710 | 14076 | 14231 | ND | 2.23 |
| ETD00711 | 14077 | 14232 | ND | 1.02 |
| ETD00712 | 14078 | 14233 | ND | 1.21 |
| ETD00713 | 14079 | 14234 | 1.09 | 0.48 |
| ETD00714 | 14080 | 14235 | 0.94 | 0.50 |
| ETD00715 | 14081 | 14236 | 0.98 | 0.65 |

TABLE 5-continued

Knockdown Activity of ANGPTL4-Specific siRNAs at 1 nM and 10 nM in Human U-138 MG cells

| siRNA name | Sense Strand SEQ ID NO: | Antisense Strand SEQ ID NO: | Relative ANGPTL4 mRNA Level | |
|---|---|---|---|---|
| | | | 1 nM siRNA | 10 nM siRNA |
| ETD00716 | 14082 | 14237 | 0.91 | 0.59 |
| ETD00717 | 14083 | 14238 | ND | 0.82 |
| ETD00718 | 14084 | 14239 | ND | 1.09 |
| ETD00719 | 14085 | 14240 | ND | 0.84 |
| ETD00720 | 14086 | 14241 | ND | 1.82 |
| ETD00721 | 14087 | 14242 | 0.64 | 0.47 |
| ETD00722 | 14088 | 14243 | ND | 1.52 |
| ETD00723 | 14089 | 14244 | ND | 1.08 |
| ETD00724 | 14090 | 14245 | ND | 0.91 |
| ETD00725 | 14091 | 14246 | ND | 0.93 |
| ETD00726 | 14092 | 14247 | ND | 0.90 |
| ETD00727 | 14093 | 14248 | ND | 0.76 |
| ETD00728 | 14094 | 14249 | 0.94 | 0.43 |
| ETD00729 | 14095 | 14250 | 1.08 | 0.71 |
| ETD00730 | 14096 | 14251 | ND | 0.80 |
| ETD00731 | 14097 | 14252 | 1.25 | 0.56 |
| ETD00732 | 14098 | 14253 | ND | 1.25 |
| ETD00733 | 14099 | 14254 | ND | 0.88 |
| ETD00734 | 14100 | 14255 | ND | 1.15 |
| ETD00735 | 14101 | 14256 | ND | 1.11 |
| ETD00736 | 14102 | 14257 | 0.90 | 0.48 |
| ETD00737 | 14103 | 14258 | ND | 1.10 |
| ETD00738 | 14104 | 14259 | ND | 0.83 |
| ETD00739 | 14105 | 14260 | ND | 1.33 |
| ETD00740 | 14106 | 14261 | ND | 1.40 |
| ETD00741 | 14107 | 14262 | ND | 0.96 |
| ETD00742 | 14108 | 14263 | ND | 1.30 |
| ETD00743 | 14109 | 14264 | 1.04 | 0.63 |
| ETD00744 | 14110 | 14265 | ND | 1.24 |
| ETD00745 | 14111 | 14266 | ND | 1.42 |
| ETD00746 | 14112 | 14267 | ND | 1.20 |
| ETD00747 | 14113 | 14268 | ND | 1.21 |

"—" untreated U-138MG cells; Negative Control siRNA, Silencer Select Negative Control #1;
ND, Not Determined

TABLE 6

Knockdown Activity of ANGPTL4-Specific siRNAs at 1 nM and 10 nM in Human U-138 MG Cells

| siRNA name | Sense Strand SEQ ID NO: | Antisense Strand SEQ ID NO: | Relative ANGPTL4 mRNA Level | |
|---|---|---|---|---|
| | | | 1 nM siRNA | 10 nM siRNA |
| Untreated Cells | — | — | 1.00 | 1.00 |
| Negative Control siRNA | — | — | 1.23 | 1.10 |
| ETD00915 | 14114 | 14269 | 1.05 | 0.85 |
| ETD00916 | 14115 | 14270 | 0.62 | 0.39 |
| ETD00917 | 14116 | 14271 | 0.84 | 0.86 |
| ETD00918 | 14117 | 14272 | 1.02 | 1.03 |
| ETD00919 | 14118 | 14273 | 1.01 | 1.02 |
| ETD00920 | 14119 | 14274 | 0.91 | 1.15 |
| ETD00921 | 14120 | 14275 | 0.78 | 0.48 |
| ETD00922 | 14121 | 14276 | 1.18 | 1.10 |
| ETD00923 | 14122 | 14277 | 0.91 | 0.93 |
| ETD00924 | 14123 | 14278 | 0.82 | 0.57 |
| ETD00925 | 14124 | 14279 | 0.79 | 0.57 |
| ETD00926 | 14125 | 14280 | 0.77 | 0.47 |
| ETD00927 | 14126 | 14281 | 0.98 | 0.73 |
| ETD00928 | 14127 | 14282 | 0.87 | 0.50 |
| ETD00929 | 14128 | 14283 | 0.91 | 0.54 |
| ETD00930 | 14129 | 14284 | 0.85 | 0.58 |
| ETD00931 | 14130 | 14285 | 0.85 | 0.46 |
| ETD00932 | 14131 | 14286 | 1.01 | 0.72 |
| ETD00933 | 14132 | 14287 | 0.38 | 0.33 |
| ETD00934 | 14133 | 14288 | 0.65 | 0.37 |

"—" untreated U-138MG cells; Negative Control siRNA, Silencer Select Negative Control #1;
ND, Not Determined

Example 5: Determining the IC50 of ANGPTL4 siRNAs

The IC50 values for knockdown of ANGPTL4 mRNA by select ANGPTL4 siRNAs were determined in U-138 MG cells. The siRNAs were assayed individually at 30 nM, 10 nM, 3 nM, 1 nM and 0.3 nM, or 3 nM, 1 nM, 0.3 nM, 0.1 nM and 0.03 nM, or 30 nM, 10 nM, 3 nM, 1 nM, 0.3 nM, 0.1 nM and 0.03 nM. The U-138 MG (ATCC® HTB-16) cells were seeded in 96-well tissue culture plates at a cell density of 7,500 cells per well in EMEM (BD Biosciences Catalog No. 670086) supplemented with 10% fetal bovine serum and incubated overnight in a water-jacketed, humidified incubator at 37° C. in an atmosphere composed of air plus 5% carbon dioxide. The ANGPTL4 siRNAs were individually transfected into U-138 MG cells in triplicate wells using 0.3 μL Lipofectamine RNAiMax (Fisher) per well. After incubation for 48 hours at 37° C., total RNA was harvested from each well and cDNA prepared using TaqMan® Fast Advanced Cells-to-CT™ Kit (ThermoFisher, Catalog #A35374) according to the manufacturer's instructions. The level of ANGPTL4 mRNA from each well was measured in triplicate by real-time qPCR on an Applied Biosystems 7500 Fast Real-Time PCR machine using TaqMan Gene Expression Assay for human ANGPTL4 (ThermoFisher, assay #Hs01101127 ml). The level of PPIA mRNA was measured using TaqMan Gene Expression Assay (ThermoFisher, assay #Hs99999904 ml) and used to determine relative ANGPTL4 mRNA levels in each well using the delta-delta Ct method. All data were normalized to relative ANGPTL4 mRNA levels in untreated U-138 MG cells. Curve fit was accomplish using the [inhibitor] vs. response (three parameters) function in GraphPad Prism software. Results are shown in Table 7.

TABLE 7

IC50 Values of ANGPTL4 siRNAs in Human U-138 MG Cells

| siRNA | [siRNA] | Relative ANGPTL4 mRNA Levels | IC50 (nM) |
|---|---|---|---|
| — | — | 1 | ND |
| ETD00714 | 30 nM | 0.27 | 4.27 |
|  | 10 nM | 0.43 |  |
|  | 3 nM | 0.52 |  |
|  | 1 nM | 0.69 |  |
|  | 0.3 nM | 0.75 |  |
| ETD00721 | 30 nM | 0.54 | 2.69 |
|  | 10 nM | 0.61 |  |
|  | 3 nM | 0.86 |  |
|  | 1 nM | 1.09 |  |
|  | 0.3 nM | 1.21 |  |
| ETD00728 | 30 nM | 0.57 | 5.10 |
|  | 10 nM | 0.79 |  |
|  | 3 nM | 0.95 |  |
|  | 1 nM | 1.29 |  |
|  | 0.3 nM | 1.27 |  |
| ETD00736 | 30 nM | 0.35 | 8.06 |
|  | 10 nM | 0.36 |  |
|  | 3 nM | 0.76 |  |
|  | 1 nM | 0.71 |  |
|  | 0.3 nM | 0.78 |  |
| ETD00916 | 3 nM | 0.20 | 0.42 |
|  | 1 nM | 0.45 |  |
|  | 0.3 nM | 0.68 |  |
|  | 0.1 nM | 0.89 |  |
|  | 0.03 nM | 1.07 |  |
| ETD00921 | 30 nM | 0.43 | 0.16 |
|  | 10 nM | 0.43 |  |
|  | 3 nM | 0.49 |  |
|  | 1 nM | 0.55 |  |
|  | 0.3 nM | 0.86 |  |
|  | 0.1 nM | 0.93 |  |
|  | 0.03 nM | 1.30 |  |
| ETD00924 | 30 nM | 0.44 | 0.54 |
|  | 10 nM | 0.47 |  |
|  | 3 nM | 0.52 |  |
|  | 1 nM | 0.63 |  |
|  | 0.3 nM | 0.82 |  |
|  | 0.1 nM | 0.91 |  |
|  | 0.03 nM | 0.99 |  |
| ETD00925 | 3 nM | 0.21 | ND |
|  | 1 nM | 0.69 |  |
|  | 0.3 nM | 0.99 |  |
|  | 0.1 nM | 0.87 |  |
|  | 0.03 nM | 0.88 |  |
| ETD00926 | 3 nM | 0.46 | 0.91 |
|  | 1 nM | 0.84 |  |
|  | 0.3 nM | 1.09 |  |
|  | 0.1 nM | 1.21 |  |
|  | 0.03 nM | 1.46 |  |

TABLE 7-continued

IC50 Values of ANGPTL4 siRNAs in Human U-138 MG Cells

| siRNA | [siRNA] | Relative ANGPTL4 mRNA Levels | IC50 (nM) |
|---|---|---|---|
| ETD00928 | 30 nM | 0.56 | 0.13 |
|  | 10 nM | 0.47 |  |
|  | 3 nM | 0.49 |  |
|  | 1 nM | 0.55 |  |
|  | 0.3 nM | 0.76 |  |
|  | 0.1 nM | 1.45 |  |
|  | 0.03 nM | 1.55 |  |
| ETD00930 | 3 nM | 0.70 | ND |
|  | 1 nM | 0.76 |  |
|  | 0.3 nM | 0.95 |  |
|  | 0.1 nM | 0.90 |  |
|  | 0.03 nM | 1.07 |  |
| ETD00931 | 3 nM | 0.29 | ND |
|  | 1 nM | 0.77 |  |
|  | 0.3 nM | 0.88 |  |
|  | 0.1 nM | 0.97 |  |
|  | 0.03 nM | 0.92 |  |
| ETD00933 | 30 nM | 0.26 | 0.13 |
|  | 10 nM | 0.26 |  |
|  | 3 nM | 0.28 |  |
|  | 1 nM | 0.29 |  |
|  | 0.3 nM | 0.37 |  |
|  | 0.1 nM | 0.67 |  |
|  | 0.03 nM | 0.71 |  |
| ETD00934 | 3 nM | 0.53 | ND |
|  | 1 nM | 0.66 |  |
|  | 0.3 nM | 0.65 |  |
|  | 0.1 nM | 0.97 |  |
|  | 0.03 nM | 0.98 |  |

"—" untreated U-138 MG cells;
ND, Not Determined

Some siRNAs having sense strands in accordance with SEQ ID NOs: 13974-13977, and having antisense strands in accordance with SEQ ID NOs: 13982-13985, were synthesized with an alternative modification pattern and are included in Table 8. The siRNAs in Table 8 were based, at least partially, on siRNAs having sense strand sequences comprising the sequences of SEQ ID NOs: 759, 1285, 1580, and 1840, and having antisense strand sequences comprising the sequences of SEQ ID NOs: 2613, 3139, 3434, and 3694.

TABLE 8

Alternative Modification Patterns of Select siRNAs

| ETD# | Sense strand sequence (5'-3') | Antisense strand sequence (5'-3') |
|---|---|---|
| ETD01062 | csasgaGfuGfgAfcu auuugaaasusu | usUfsucaAfauaguc cAfcUfcugsusu |
| ETD01063 | asgscuUfaAfgAfag ggaaucuasusu | usAfsgauUfcccuuc uUfaAfgcususu |
| ETD01064 | gsasucGfaGfgCfug caggauaasusu | usUfsaucCfugcagc cUfcGfaucsusu |
| ETD01065 | csasgaGfuUfcUfug gaauaaaasusu | usUfsuuaUfuccaag aAfcUfcugsusu |

| ETD# | Sense strand - SEQ ID NO: | Antisense strand - SEQ ID NO: |
|---|---|---|
| ETD01062 | 13986 | 14134 |
| ETD01063 | 13987 | 14135 |
| ETD01064 | 13988 | 14136 |
| ETD01065 | 13989 | 14137 |

IC50 values for knockdown of ANGPTL4 mRNA for ETD01062, ETD01063, ETD01064 and ETD01065 ANGPTL4 siRNAs were determined in U-138 MG cells. The siRNAs were assayed individually at 30 nM, 10 nM, 3 nM, 1 nM, 0.3 nM, 0.1 nM and 0.03 nM. The U-138 MG (ATCC® HTB-16) cells were seeded in 96-well tissue culture plates at a cell density of 7,500 cells per well in EMEM (BD Biosciences Catalog No. 670086) supplemented with 10% fetal bovine serum and incubated overnight in a water-jacketed, humidified incubator at 37° C. in an atmosphere composed of air plus 5% carbon dioxide. The ANGPTL4 siRNAs were individually transfected into U-138 MG cells in triplicate wells using 0.3 µL Lipofectamine RNAiMax (Fisher) per well. After incubation for 48 hours at 37° C., total RNA was harvested from each well and cDNA prepared using TaqMan® Fast Advanced Cells-to-CT™ Kit (ThermoFisher, Catalog #A35374) according to the manufacturer's instructions. The level of ANGPTL4 mRNA from each well was measured in triplicate by real-time qPCR on an Applied Biosystems 7500 Fast Real-Time PCR machine using TaqMan Gene Expression Assay for human ANGPTL4 (ThermoFisher, assay #Hs01101127_m1). The level of PPIA mRNA was measured using TaqMan Gene Expression Assay (ThermoFisher, assay #Hs99999904_m1) and used to determine relative ANGPTL4 mRNA levels in each well using the delta-delta Ct method. All data were normalized to relative ANGPTL4 mRNA levels in untreated U-138 MG cells. Curve fit was accomplished using the [inhibitor] vs. response (three parameters) function in GraphPad Prism software. Results are shown in Table 9.

TABLE 9

IC50 Values of ETD01062, ETD01063, ETD01064 and ETD01065 ANGPTL4 siRNAs in Human U-138 MG Cells

| siRNA | [siRNA] | Relative ANGPTL4 mRNA Levels | IC50 (nM) |
|---|---|---|---|
| — | — | 1 | ND |
| ETD01062 | 30 nM | 0.41 | 0.22 |
|  | 10 nM | 0.39 |  |
|  | 3 nM | 0.36 |  |
|  | 1 nM | 0.42 |  |
|  | 0.3 nM | 0.63 |  |
|  | 0.1 nM | 0.70 |  |
|  | 0.03 nM | 0.82 |  |
| ETD01063 | 30 nM | 0.68 | 1.24 |
|  | 10 nM | 0.62 |  |
|  | 3 nM | 0.62 |  |
|  | 1 nM | 0.71 |  |
|  | 0.3 nM | 1.54 |  |
|  | 0.1 nM | 1.15 |  |
|  | 0.03 nM | 0.89 |  |
| ETD01064 | 30 nM | 0.83 | 0.25 |
|  | 10 nM | 0.41 |  |
|  | 3 nM | 0.57 |  |
|  | 1 nM | 0.57 |  |
|  | 0.3 nM | 0.71 |  |
|  | 0.1 nM | 1.27 |  |
|  | 0.03 nM | 0.89 |  |
| ETD01065 | 30 nM | 0.24 | 0.07 |
|  | 10 nM | 0.23 |  |
|  | 3 nM | 0.20 |  |
|  | 1 nM | 0.27 |  |
|  | 0.3 nM | 0.31 |  |
|  | 0.1 nM | 0.42 |  |
|  | 0.03 nM | 0.56 |  |

"—" untreated U-138 MG cells;
ND, Not Determined

Example 6: Assessing the Extent of Nuclease Resistance of ANGPTL4 siRNAs

Resistance of select ANGPTL4 siRNAs to nuclease digestion was assessed by incubating the siRNAs in rat liver tritosomes. Each siRNA (7 ng/µL final concentration) was placed into a PCR tube containing a cocktail prepared on ice containing 1× catabolic buffer (Xenotech, Catalog #K5200, Lot #18-1-0698), 0.5× rat tritosomes (Xenotech, Catalog #R0610.LT, Lot #1610405), 0.1 U/4 porcine intestinal heparin (Zageno, Catalog #H3149-10KU). An aliquot was removed, an equal volume of 50 mM EDTA was added, and the sample placed at −80° C. This sample was designated as the 0 hr timepoint. The remainder of the reaction was placed in an Eppendorf Mastercycler Gradient and incubated at 37° C. After incubation for 4 and 24 hours, an aliquot was removed from the reaction and stopped by addition of an equal volume of 50 mM EDTA and placed at −80° C. until analysis by gel electrophoresis. All samples were then thawed on ice and 6×DNA Gel Loading Dye (ThermoFisher Catalog #R0611) was added to 1× final concentration. 20 µL of each sample was loaded onto a 20% polyacrylamide TBE gel (ThermoFisher, Catalog #EC63155BOX). Electrophoresis was carried out at a constant 100V for 75 minutes in an XCell SureLock Mini-Cell Electrophoresis System (ThermoFisher) using 1× TBE (Tris/boric/EDTA) (Fisher, Catalog #FERB52) as the tank buffer. The siRNA was visualized by staining the gel with a 1:10,000 dilution of SYBR Gold (ThermoFisher, Catalog #S-11494) in TBE for 15 minutes at room temperature with rocking. The gel was washed with 1× TBE for 15 minutes and then placed on a FotoPrep1 UV transilluminator (Fotodyne). The gel was imaged using the camera app set on MONO on an iPhone 6s with a yellow gel filter (Neewer) placed over the lens. Band intensity was measured using NIH ImageJ using the "Analyze: Gels" function. The remaining siRNA percent was normalized to the value obtained at the 0 hr timepoint for that siRNA. Results are shown in Table 10. By using this assay, we were able to determine that some siRNAs are more resistant to nuclease digestion with more remaining intact over time compared with other siRNAs with the same modification pattern.

TABLE 10

Resistance of ANGPTL4 siRNAs to Nucleases Present in Rat Liver Tritosomes

| siRNA | Timepoint (hr) | % remaining |
|---|---|---|
| ETD00686 | 0 | 100% |
|  | 4 | 79% |
|  | 24 | 27% |
| ETD00714 | 0 | 100% |
|  | 4 | 66% |
|  | 24 | 33% |
| ETD00721 | 0 | 100% |
|  | 4 | 77% |
|  | 24 | 47% |
| ETD00728 | 0 | 100% |
|  | 4 | 74% |
|  | 24 | 32% |
| ETD00736 | 0 | 100% |
|  | 4 | 81% |
|  | 24 | 39% |
| ETD00916 | 0 | 100% |
|  | 4 | 85% |
|  | 24 | 59% |
| ETD00924 | 0 | 100% |
|  | 4 | 68% |
|  | 24 | 24% |
| ETD00926 | 0 | 100% |
|  | 4 | 74% |
|  | 24 | 47% |

TABLE 10-continued

Resistance of ANGPTL4 siRNAs to Nucleases Present in Rat Liver Tritosomes

| siRNA | Timepoint (hr) | % remaining |
|---|---|---|
| ETD00928 | 0 | 100% |
| | 4 | 73% |
| | 24 | 25% |
| ETD00933 | 0 | 100% |
| | 4 | 73% |
| | 24 | 28% |

Example 7: Screening ANGPTL4 ASOs for Activity in Cells in Culture

ANGPTL4 ASOs with sequences provided in SEQ ID NOs: 3709-13934 and those possessing modification pattern ASO1 (SEQ ID NO: 13969) are to be assayed for ANGPTL4 mRNA reduction activity in cells in culture. A cell line such as ARPE-19 that expresses ANGPTL4 (ATCC® CRL-2302) will be seeded in 96-well tissue culture plates at a cell density of 10,000 cells per well in DMEM supplemented with 10% fetal bovine serum and incubated overnight in a water-jacketed, humidified incubator at 37° C. in an atmosphere of air plus 5% carbon dioxide. The ANGPTL4 ASOs are individually transfected into cells in duplicate wells at 1 uM final concentration using 0.3 uL Lipofectamine RNAiMax (Fisher) per well. A negative control ASO (SEQ ID NO: 13953) is also transfected at 1 uM final concentration. After incubation for 48 hours at 37° C., total RNA is harvested from each well and cDNA prepared using TaqMan® Fast Advanced Cells-to-CT™ Kit (ThermoFisher, Catalog #A35374) according to the manufacturer's instructions. The level of ANGPTL4 mRNA from each well will be measured in triplicate by real-time qPCR on an Applied Biosystems 7500 Fast Real-Time PCR machine using TaqMan Gene Expression Assay for human ANGPTL4 (ThermoFisher, assay #Hs01101127_m1). The level of PPIA mRNA is measured using TaqMan Gene Expression Assay (ThermoFisher, assay #Hs99999904_m1) and used to determine relative ANGPTL4 mRNA levels in each well using the delta-delta Ct method. Data are normalized to relative ANGPTL4 mRNA levels in untreated ARPE-19 cells.

The ANGPTL4 ASOs showing the greatest degree of reduction of ANGPTL4 mRNA at 1 uM are to be tested in a second screen for activity at 100 nM concentration using the transfection procedures as described above.

Example 8: GalNAc Ligand for Hepatocyte Targeting of Oligonucleotides

Without limiting the disclosure to these individual methods, there are at least two general methods for attachment of multivalent N-acetylgalactosamine (GalNAc) ligands to oligonucleotides: solid or solution-phase conjugations. GalNAc ligands may be attached to solid phase resin for 3' conjugation or at the 5' terminus using GalNAc phosphoramidite reagents. GalNAc phosphoramidites may be coupled on solid phase as for other nucleosides in the oligonucleotide sequence at any position in the sequence. Reagents for GalNAc conjugation to oligonucleotides are shown in Table 11.

TABLE 11

GalNAc Conjugation Reagents

| Type of conjugation | Structure |
|---|---|
| Solid phase 3' attachment where squiggly line is rest of oligonucleotide chain and rightmost OH is where attachment' to solid phase is. | 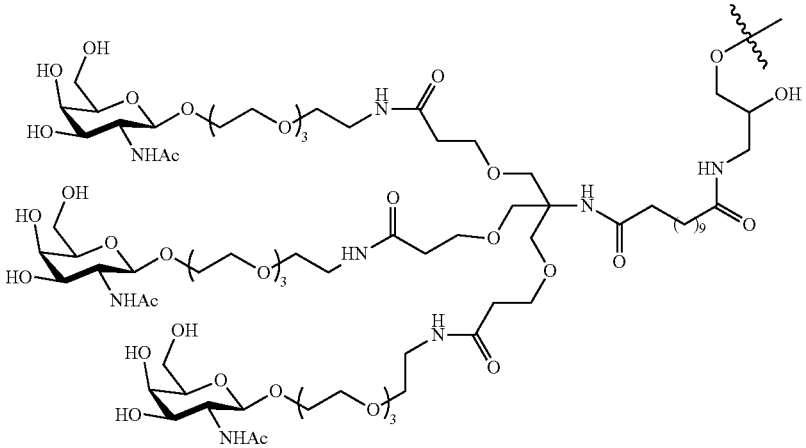 |

This GalNAc ligand may be referred to as "GalNAc23" or "GalNAc#23."

TABLE 11-continued

GalNAc Conjugation Reagents

| Type of conjugation | Structure |
|---|---|
| Solid phase 5' attachment phosphoramidite | *[chemical structure]* |
| Solid phase 5' attachment Phosphoramidite | *[chemical structure]* |

TABLE 11-continued

GalNAc Conjugation Reagents

| Type of conjugation | Structure |
|---|---|
| Solution phase Carboxylic acid for amide coupling anywhere on oligonucleotide | 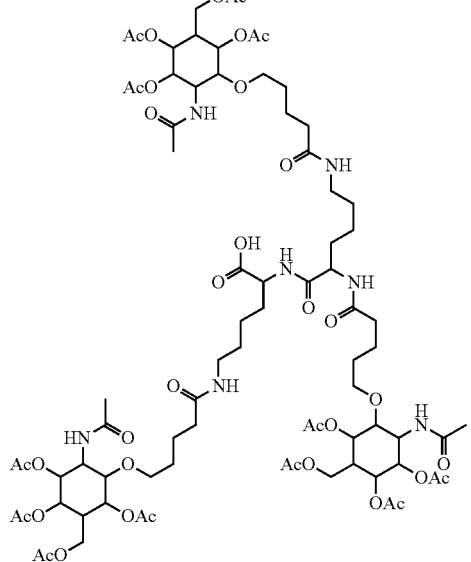 |

Where Ac is an acetyl group or other hydroxyl protecting group that can be removed under basic, acid or reducing conditions.

In solution phase conjugation, the oligonucleotide sequence—including a reactive conjugation site—is formed on the resin. The oligonucleotide is then removed from the resin and GalNAc is conjugated to the reactive site.

The carboxy GalNAc derivatives may be coupled to amino-modified oligonucleotides. The peptide coupling conditions are known to the skilled in the art using a carbodiimide coupling agent like DCC (N,N'-Dicyclohexylcarbodiimide), EDC (N-(3-dimethylaminopropyl)-N'-ethylcarbodiimide) or EDC.HCl (N-(3-dimethylaminopropyl)-N'-ethylcarbodiimide hydrochloride and an additive like HOBt (1-hydroxybenztriazole), HOSu (N-hydroxysuccinimide), TBTU (N,N,N,N-Tetramethyl-O-(benzotriazol-1-yl)uronium tetrafluoroborate, HBTU (2-(1H-benzotriazol-1-yl)-1,1,3,3-tetramethyluronium hexafluorophosphate) or HOAt (1-Hydroxy-7-azabenzotriazole and common combinations thereof such as TBTU/HOBt or HBTU/HOAt to form activated amine-reactive esters.

Amine groups may be incorporated into oligonucleotides using a number of known, commercially available reagents at the 5' terminus, 3' terminus or anywhere in between.

Non-limiting examples of reagents for oligonucleotide synthesis to incorporate an amino group include:
5' attachment:
6-(4-Monomethoxytritylamino)hexyl-(2-cyanoethyl)-(N,N-diisopropyl)-phosphoramidite CAS Number: 114616-27-2
5'-Amino-Modifier TEG CE-Phosphoramidite
10-(O-trifluoroacetamido-N-ethyl)-triethyleneglycol-1-[(2-cyanoethyl)-(N,N-diisopropyl)]-phosphoramidite
3' attachment:
3'-Amino-Modifier Serinol CPG
3-Dimethoxytrityloxy-2-(3-(fluorenylmethoxycarbonylamino)propanamido)propyl-1-O-succinyl-long chain alkylamino-CPG (where CPG stands for controlled-pore glass and is the solid support)
Amino-Modifier Serinol Phosphoramidite
3-Dimethoxytrityloxy-2-(3-(fluorenylmethoxycarbonylamino)propanamido)propyl-1-O-(2-cyanoethyl)-(N,N-diisopropyl)-phosphoramidite
Internal (base modified):
Amino-Modifier C6 dT
5'-Dimethoxytrityl-5-[N-(trifluoroacetylaminohexyl)-3-acrylimido]-2'-deoxyUridine,3'-[(2-cyanoethyl)-(N,N-diisopropyl)]-phosphoramidite. CAS Number: 178925-21-8

Solution phase conjugations may occur after oligonucleotide synthesis via reactions between non-nucleosidic nucleophilic functional groups that are attached to the oligonucleotide and electrophilic GalNAc reagents. Examples of nucleophilic groups include amines and thiols, and examples of electrophilic reagents include activated esters (e.g. N-hydroxysuccinimide, pentafluorophenyl) and maleimides.

Example 9: Inhibition of ANGPTL4 in a Mouse Model of Hypertriglyceridemia

In this experiment, a murine model of hypertriglyceridemia is to be used to evaluate the effect of siRNA or ASO inhibition of ANGPTL4 expressed in the liver compared to an anti-mouse ANGPTL4 antibody. The mouse strain C57Bl/6 Apoetm1Unc mice (Jackson Labs) will be maintained on a high fat Western diet (Research Diets, D12492; 60% fat by calories).

Four groups of mice (n=12/group) will be utilized in this study. Animals will be maintained on a high fat diet during the study. On Day −4 before the first injection, chow will be removed for an overnight fast. On Day −3 before the first injection, all animals will be anesthetized and 300 uL of blood collected in serum separator tubes via the submandibular vein to assess baseline triglyceride, serum glucose, insulin sensitivity, total cholesterol levels, HDL Cholesterol levels, liver function and serum levels of ANGPTL4 protein. On Study Day 0, Group 1 mice will be injected intraperitoneally with 600 uL normal saline, Group 2 mice will be injected intraperitoneally with 600 ug of anti-mouse ANGPTL4 antibody in 600 uL, Group 3 mice will be injected subcutaneously with 100 ug of GalNAc-ANGPTL4 siRNA targeting mouse ANGPTL4 with sense strand selected from sequences provided in SEQ ID NO: 13937-13944, 14289, or 14291, and antisense strands selected from sequences provided in SEQ ID NO: 13945-13952, 14290, or 14292, in 200 uL of normal saline, and Group 4 mice will be injected subcutaneously with 150 ug of GalNAc-ANGPTL4 ASO targeting mouse ANGPTL4 in 200 uL of normal saline. The sense strands selected from sequences provided in SEQ ID NO: 13937-13944, 14289, or 14291 will comprise a GalNAc ligand attached to the 3' end of the sense strands. On the afternoon of Day 3, the chow will be removed from all Groups for an overnight fast. On Day 4, the animals from all Groups will be anesthetized and 150 uL of blood collected in serum separator tubes via the submandibular vein to assess serum triglycerides, glucose, total cholesterol, HDL cholesterol and levels of ANGPTL4 protein. Animals from all groups will then undergo an oral glucose tolerance test and insulin tolerance test to evaluate insulin sensitivity. Chow will be supplied again as normal after blood has been collected and insulin sensitivity tests conducted. Weekly thereafter starting on Day 7 the animals from Group 2 will be dosed as on Day 0 for a total of 15 injections. Every other week thereafter starting on Day 14 the animals from Group 3 and Group 4 will be dosed as on Day 0 for a total of 8 injections. Every other week starting on Day 10, the mice from all Groups will be fasted (overnight) and bled (150 uL into serum separator tubes) to assess serum triglyceride, glucose, total cholesterol, HDL cholesterol and levels of ANGPTL4 protein, and undergo insulin sensitivity tests. On the third day after the final injection, the chow will be removed from all Groups for an overnight fast. On the fourth day after the final injection, the animals from all Groups will be anesthetized, euthanized and bled via cardiac puncture to collect 500 uL of blood into serum separator tubes to assess triglyceride, serum glucose, insulin sensitivity, total cholesterol levels, HDL cholesterol levels, liver function and serum levels of ANGPTL4 protein. Tissue from the liver, small intestine and mesenteric lymph nodes will be collected from all animals and immersed in 10% neutral buffered formalin for histopathological analysis. A liver sample will also be collected from all animals and placed in RNAlater. The levels of ANGPTL4 mRNA will be assessed by RT-qPCR using TaqMan assays for mouse ANGPTL4 (ThermoFisher, assay #Mm00480431_m1) and the mouse housekeeping gene PPIA (ThermoFisher, assay #Mm02342430_g1).

Animals treated with the anti-mouse ANGPTL4 antibody (Group 2), mice treated with GalNAc-ANGPTL4 siRNA (Group 3), and mice treated with GalNAc-ANGPTL4 ASO (Group 4) are expected to have decreased triglycerides, total serum cholesterol, serum glucose as well as decreased serum ANGPTL4 protein levels, and increased HDL cholesterol and insulin sensitivity, compared with mice from Group 1 (saline). Animals in Group 2 and Group 3 are also expected to have decreased ANGPTL4 mRNA in liver samples.

Example 10: Inhibition of ANGPTL4 in Non-Human Primates Using GalNAc-ANGPTL4 siRNA and GalNAc-ANGPTL4 ASO In this experiment, a NHP model of hypertriglyceridemia is used to evaluate the effect of siRNA or ASO inhibition of ANGPTL4 expressed in the liver. Three groups of cynomolgus monkeys will be used (n=5/group) that are placed on a high-fat diet (Western Primate Diet, 5S2T) before the initiation of the study. Alternatively, three groups of rhesus monkeys will be used (n=5/group) that are placed on a high fructose diet before the initiation of the study. Animals are to be given 7 biweekly subcutaneous injections of saline (Group 1), GalNAc-ANGPTL4 siRNA (Group 2), or GalNAc-ANGPTL4 ASO (Group 3). The modified GalNAc-ANGPTL4 siRNA sequences are chosen from subset A that are cross-reactive between human and NHP, and include modification pattern 1S, 2S or 3S and 1AS or 3AS. Other GalNAc-ANGPTL4 siRNA sequences may be chosen from subset F that are cross-reactive between human and NHP, or modifications thereof. Blood samples for lipid and glycemic measurements will be collected at baseline and at 4, 8, and 14 weeks of the study and analyzed for lipid content, serum glucose, insulin sensitivity and ANGPTL4 protein. All animals from each group are necropsied 2 weeks after the last blood collection. Tissue from the liver, small intestine and mesenteric lymph nodes will be collected from all animals and immersed in 10% neutral buffered formalin for histopathological analysis. A liver sample will also be collected from all animals and placed in RNAlater. The levels of ANGPTL4 mRNA will be assessed by RT-qPCR using TaqMan assays for cynomolgus ANGPTL4 (ThermoFisher, assay #Mf01101127_m1) or rhesus ANGPTL4, and the cynomolgus housekeeping gene PPIA (ThermoFisher, assay #Mf04932064_gH) or rhesus PPIA.

It is expected that animals treated with the GalNAc ANGPTL4 siRNA (Group 2) and animals treated with GalNAc-ANGPTL4 ASO (Group 3) will show decreased triglycerides, total serum cholesterol and serum glucose as well as decreased serum ANGPTL4 protein levels, and increased HDL cholesterol and insulin sensitivity, compared with animals from Group 1 (saline). It is also expected that animals in Group 1 and Group 3 will show decreased ANGPTL4 mRNA in liver samples.

Example 11: Inhibition of ANGPTL4 in a Clinical Trial Using GalNAc-ANGPTL4 siRNA and GalNAc-ANGPTL4 ASO In this study, human subjects with hypertriglyceridemia are used to evaluate the effect of siRNA or ASO inhibition of ANGPTL4 expressed in the liver. Selection criteria for inclusion in the study are ages 40-90, BMI≥30, and serum triglycerides≥250 mg/dL. Three groups of subjects will be included (n=15/group) in the study. Subjects are to be given 5 weekly subcutaneous injections of saline (Group 1), GalNAc-ANGPTL4 siRNA (Group 2), or GalNAc-ANGPTL4 ASO (Group 3). The modified GalNAc-ANGPTL4 siRNA sequences are chosen from subset A that show high activity in cells in culture in the experiments of Example 4. Blood samples for lipid and glycemic measurements will be collected at baseline and at 3, 6, and 12 weeks of the study and analyzed for lipid content, serum glucose, insulin sensitivity, ANGPTL4 protein, and liver and kidney function.

It is expected that subjects treated with the GalNAc ANGPTL4 siRNA (Group 2) and subjects treated with GalNAc-ANGPTL4 ASO (Group 3) will show decreased triglycerides, total serum cholesterol and serum glucose as well as decreased serum ANGPTL4 protein levels, and increased HDL cholesterol and insulin sensitivity, compared with subjects from Group 1 (saline).

Example 12: siRNA-Mediated Knockdown of ANGPTL4 in a Mouse Model of Hypertriglyceridemia The effects of siRNA-mediated knockdown of ANGPTL4 in the liver was investigated in a murine model of hypertriglyceridemia. Eight- to ten-week-old C57Bl/6 Apoetm1Unc mice (Jackson Labs) were placed on a high fat Western diet (Research Diets, D12492; 60% fat by calories) for two weeks prior to the start of the study on Day 0. On Day 0 and Day 7, mice in Group 1 (n=4) were given 200 uL of phosphate buffered saline (PBS) and mice in Group 2 (n=4) were given 200 ug of the siRNA targeting mouse ANGPTL4 (ETD00642: sense strand having the sequence of SEQ ID NO: 13941 and a 3' conjugated GalNAc ligand, and antisense strand having the sequence of SEQ ID NO: 13949) in 200 uL PBS by subcutaneous injection. Serum samples were collected from all mice fed ad libidum on Day 13. On Day 14, serum samples were collected from all mice after a 24 hour fast. Clinical chemistry assays including those for triglyceride and glucose were performed at IDEXX Laboratories, Incorporated. All mice were then euthanized and a liver sample from each was collected and placed in RNAlater (ThermoFisher Cat #AM7020). Total liver RNA was prepared by homogenizing the liver tissue in homogenization buffer (Maxwell RSC simplyRNA Tissue Kit) using a Percellys 24 tissue homogenizer (Bertin Instruments) set at 5000 rpm for two 10 second cycles. Total RNA from the lysate was purified on a Maxwell RSC 48 platform (Promega Corporation) according to the manufacturer's recommendations. The levels of liver ANGPTL4 mRNA were assessed by RT-qPCR using TaqMan assays for mouse ANGPTL4 (ThermoFisher, assay #Mm00480431_m1) and the mouse housekeeping gene PPIA (ThermoFisher, assay #Mm02342430_g1). Data were normalized to the level in animals receiving PBS (Group 1). Results are shown in Table 12. Mice receiving ETD00642 (Group2) had reduced levels of liver ANGPTL4 mRNA compared to mice receiving PBS (Group 1).

TABLE 12

Day 14 ANGPTL4 mRNA Levels in Mice Treated with ETD00642

| Group # | Animal # | Relative Liver ANGPTL4 mRNA Level | Mean Relative Liver ANGPTL4 mRNA level |
|---|---|---|---|
| 1 | 1 | 1.30 | 1.00 |
|   | 2 | 0.95 |  |
|   | 3 | 1.11 |  |
|   | 4 | 0.73 |  |
| 2 | 5 | 0.48 | 0.47 |
|   | 6 | 0.55 |  |
|   | 7 | 0.51 |  |
|   | 8 | 0.36 |  |

The levels of triglycerides and glucose are shown in Table 13. The serum triglyceride levels in fed mice on Day 13 and fasted mice on Day 14 were lower in mice receiving ETD00642 (Group 2) than in control mice receiving PBS (Group1). The serum glucose levels in fed mice on Day 13 were lower in mice receiving ETD00642 (Group 2) than in control mice receiving PBS (Group1). The serum glucose levels in fasted mice on Day 14 were also lower in mice receiving ETD00642 (Group 2) than in control mice receiving PBS (Group1), but the difference between Groups was less than that in the fasted mice.

TABLE 13

Triglyceride and Glucose Levels in Mice Treated with ETD00642

| | | Triglycerides (mg/dL) | | | | Glucose (mg/dL) | | | |
|---|---|---|---|---|---|---|---|---|---|
| | | Fed (Day 13) | | Fasted (Day 14) | | Fed (Day 13) | | Fasted (Day 14) | |
| Group # | Animal # | individual | Mean | individual | Mean | individual | Mean | individual | Mean |
| 1 | 1 | 180 | 201 | 119 | 117 | 297 | 296 | 129 | 103 |
|   | 2 | 213 |     | 135 |     | 300 |     | 110 |     |
|   | 3 | 193 |     | 99  |     | 305 |     | 91  |     |
|   | 4 | 217 |     | 113 |     | 280 |     | 80  |     |
| 2 | 5 | 148 | 140 | 65  | 69  | 210 | 202 | 97  | 89  |
|   | 6 | 158 |     | 66  |     | 218 |     | 100 |     |
|   | 7 | 66  |     | 61  |     | 221 |     | 76  |     |
|   | 8 | 186 |     | 85  |     | 158 |     | 83  |     |

Example 13: Activity of siRNAs Targeting ANGPTL4 in Non-Human Primates

The activity of four siRNAs targeting ANGPTL4 were tested individually in cynomolgus monkeys. The siRNAs utilized in this study included ETD01117, ETD01118, ETD01119, and ETD01120 (see Table 16 for siRNA details).

Female cynomolgus monkeys (*Macaca fascicularis*, Cambodian origin, Orient BioResource Center, Alice, Tex.) were at least 18 months of age and weighed 2.5-3 kg at study start. After arrival, the animals were pair housed in stainless steel cages suspended over flush pans. Fluorescent lighting on a 12 hour on/off cycle was used and the temperature maintained at 18-29□ C. at a target relative humidity of 30-70% with at least 10-15 air exchanges per hour. Animals were acclimated for a period of at least twenty-eight days, during which time they were examined for overall general health and observed daily. Animals were limit fed daily with certified primate diet (5048). Tap water was provided ad libitum.

Monkeys (3/group) were administered the siRNA test article once on Day 0 by subcutaneous injection as described in Table 14. In-life, animals were evaluated for clinical signs of toxicity, body weights, and food consumption. Prior to and during the study evaluations for clinical chemistry parameters were performed.

TABLE 14 siRNA Dosing Information

| Group | siRNA | Dosage (mg/kg) | Conc. (mg/mL) | Animal No. |
|---|---|---|---|---|
| 1 | ETD01117 | 5 | 50 | 1-3 |
| 2 | ETD01118 | 5 | 50 | 4-6 |
| 3 | ETD01119 | 5 | 50 | 7-9 |
| 4 | ETD01120 | 5 | 50 | 10-12 |

Whole blood (approximately 2-3 mL) was collected from fasted animals twice prior to first dose (Day −7 and −2), and from surviving animals on Days 7, 14. Whole blood (approximately 2-3 mL) was collected from non-fasted animals once prior to dosing (Day −8). Blood samples were analyzed for clinical chemistry parameters, processed to serum for measurement of ANGPTL4 levels, and processed to plasma for lipoprotein profile assay.

An AlphaLISA immunoassay (PerkinElmer AL3017) was used to measure serum ANGPTL4 levels according to the recommended protocols provided by the manufacturer. Briefly, standard analyte (recombinant human ANGPTL4 encoding residues Gly26-Ser406) and serum samples were prepared in 1× AlphaLISA Assay Buffer (PerkinElmer AL000C). For each assay, 5 µL of prepared standard analyte or diluted sample were added to a 96-well white ½ Area OptiPlate (PerkinElmer 6002290) followed by the addition of 10 µL of Acceptor bead mix. Then the plate was sealed with TopSeal A-PLUS (PerkinElmer 6050185) and incubated for 30 minutes at room temperature. Next, 10 µL of biotinylated antibody was added to each well of the plate. The plate was sealed and incubated for 60 minutes at room temperature. Afterwards, 25 µL of streptavidin Donor beads were added in the dark to prevent photobleaching. The plate was sealed, covered with foil, and incubated at room temperature for 30 minutes prior to measuring AlphaLISA signal. All Alpha assays were measured on the Alpha-enabled EnVision multilabel plate reader using the 640 as mirror module (#444) and the M570w emission filter (#244). Standard Alpha measurement settings were used: excitation wavelength at 680 nm was used to excite Donor beads and emission wavelength at 615 nm measured as Alpha signal; total measurement time 550 ms and excitation time 180 ms were used. A standard curve was generated by plotting the Alpha signal counts versus the concentration of analyte using GraphPad Prism version 9 for macOS (GraphPad Software). The curve was fit according to a nonlinear regression using the 4-parameter logistic equation (sigmoidal dose-response curve with variable slope) and a 1/Y2 data weighting. Signal for samples was converted to pg/mL from interpolation of the standard curve from each plate and corrected for dilution of sample prior to assay. The results are shown in Table 15. Results indicate that after treatment with siRNAs targeting ANGPTL4 the mean levels of ANGPTL4 protein in serum were reduced. In addition, mean levels of serum ANGPTL4 protein levels were lower in fed animals than in fasted animals.

TABLE 15

Serum ANGPTL4 Protein Levels in Non-Human Primates Treated with ANGPTL4 siRNAs

| Group # (n = 3) | siRNA | Day | Group Means* |
|---|---|---|---|
| 1 | ETD01117 | −8 (fed) | 0.66 |
| | | −7 | 0.97 |
| | | −2 | 1.03 |
| | | 7 | 0.66 |
| | | 14 | 0.38 |
| 2 | ETD01118 | −8 (fed) | 0.68 |
| | | −7 | 1.10 |
| | | −2 | 0.90 |
| | | 7 | 0.61 |
| | | 14 | 0.68 |
| 3 | ETD01119 | −8 (fed) | 0.73 |
| | | −7 | 1.07 |
| | | −2 | 0.93 |
| | | 7 | 0.50 |
| | | 14 | 0.65 |
| 4 | ETD01120 | −8 (fed) | 0.49 |
| | | −7 | 0.94 |
| | | −2 | 1.06 |
| | | 7 | 0.52 |
| | | 14 | 0.52 |

*relative to the mean of Day −7 and Day −2 values in each group

Example 14: siRNAs Targeting ANGPTL4

Some non-limiting examples of siRNAs have one or more characteristics of the siRNAs in Table 16.

TABLE 16

Exemplary modified siRNAs

| siRNA Name | Sense Strand Sequence SEQ ID NO: | Additional Characteristic of Sense Strand | Antisense Strand Sequence - SEQ ID NO: |
|---|---|---|---|
| ETD01062 | 13986 | — | 14134 |
| ETD01063 | 13987 | — | 14135 |
| ETD01064 | 13988 | — | 14136 |
| ETD01065 | 13989 | — | 14137 |
| ETD01117 | 13990 | GalNAc#23 conjugated at 3' end | 14134 |
| ETD01118 | 13991 | GalNAc#23 conjugated at 3' end | 14135 |
| ETD01119 | 13992 | GalNAc#23 conjugated at 3' end | 14136 |
| ETD01120 | 13993 | GalNAc#23 conjugated at 3' end | 14137 |
| ETD01117.1 | 13994 | GalNAc ligand conjugated at 5' end | 14134 |
| ETD01118.1 | 13995 | GalNAc ligand conjugated at 5' end | 14135 |
| ETD01119.1 | 13996 | GalNAc ligand conjugated at 5' end | 14136 |
| ETD01120.1 | 13997 | GalNAc ligand conjugated at 5' end | 14137 |
| ETD01117.2 | 13998 | GalNAc ligand conjugated at 5' end | 14134 |

TABLE 16-continued

Exemplary modified siRNAs

| siRNA Name | Sense Strand Sequence SEQ ID NO | Additional Characteristic of Sense Strand | Antisense Strand Sequence - SEQ ID NO: |
|---|---|---|---|
| ETD01118.2 | 13999 | GalNAc ligand conjugated at 5' end | 14135 |
| ETD01119.2 | 14000 | GalNAc ligand conjugated at 5' end | 14136 |
| ETD01120.2 | 14001 | GalNAc ligand conjugated at 5' end | 14137 |
| ETD01117.3 | 14006 | GalNAc ligand conjugated at 5' end | 14138 |
| ETD01118.3 | 14007 | GalNAc ligand conjugated at 5' end | 14139 |
| ETD01119.3 | 14008 | GalNAc ligand conjugated at 5' end | 14140 |
| ETD01120.3 | 14009 | GalNAc ligand conjugated at 5' end | 14141 |
| ETD01117.4 | 14006 | GalNAc ligand conjugated at 5' end | 14142 |
| ETD01118.4 | 14007 | GalNAc ligand conjugated at 5' end | 14143 |
| ETD01119.4 | 14008 | GalNAc ligand conjugated at 5' end | 14144 |
| ETD01120.4 | 14009 | GalNAc ligand conjugated at 5' end | 14145 |
| ETD01117.5 | 14006 | GalNAc ligand conjugated at 5' end | 14146 |
| ETD01118.5 | 14007 | GalNAc ligand conjugated at 5' end | 14147 |
| ETD01119.5 | 14008 | GalNAc ligand conjugated at 5' end | 14148 |
| ETD01120.5 | 14009 | GalNAc ligand conjugated at 5' end | 14149 |
| ETD01117.6 | 14006 | GalNAc ligand conjugated at 5' end | 14150 |
| ETD01118.6 | 14007 | GalNAc ligand conjugated at 5' end | 14151 |
| ETD01119.6 | 14008 | GalNAc ligand conjugated at 5' end | 14152 |
| ETD01120.6 | 14009 | GalNAc ligand conjugated at 5' end | 14153 |
| ETD01117.7 | 14002 | GalNAc ligand conjugated at 5' end | 14154 |
| ETD01118.7 | 14003 | GalNAc ligand conjugated at 5' end | 14155 |
| ETD01119.7 | 14004 | GalNAc ligand conjugated at 5' end | 14156 |
| ETD01120.7 | 14005 | GalNAc ligand conjugated at 5' end | 14157 |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (14292 sequences)

SEQ ID NO: 1 - RNA, 19 nt, Artificial Sequence
  Description of Artificial Sequence: Synthetic oligonucleotide
agaagccgagcugagcgga

SEQ ID NO: 2 - RNA, 19 nt, Artificial Sequence
  Description of Artificial Sequence: Synthetic oligonucleotide
gaagccgagcugagcggau

SEQ ID NO: 3 - RNA, 19 nt, Artificial Sequence
  Description of Artificial Sequence: Synthetic oligonucleotide
aagccgagcugagcggauc

SEQ ID NO: 4 - RNA, 19 nt, Artificial Sequence
  Description of Artificial Sequence: Synthetic oligonucleotide
agccgagcugagcggaucc

SEQ ID NO: 5 - RNA, 19 nt, Artificial Sequence
  Description of Artificial Sequence: Synthetic oligonucleotide
gccgagcugagcggauccu

SEQ ID NO: 6 - RNA, 19 nt, Artificial Sequence
  Description of Artificial Sequence: Synthetic oligonucleotide
ccgagcugagcggauccuc

SEQ ID NO: 7 - RNA, 19 nt, Artificial Sequence
  Description of Artificial Sequence: Synthetic oligonucleotide
cgagcugagcggauccuca

SEQ ID NO: 8 - RNA, 19 nt, Artificial Sequence
  Description of Artificial Sequence: Synthetic oligonucleotide
gagcugagcggauccucac

SEQ ID NO: 9 - RNA, 19 nt, Artificial Sequence
  Description of Artificial Sequence: Synthetic oligonucleotide
agcugagcggauccucaca

SEQ ID NO: 10 - RNA, 19 nt, Artificial Sequence
  Description of Artificial Sequence: Synthetic oligonucleotide
gcugagcggauccucacac

SEQ ID NO: 11 - RNA, 19 nt, Artificial Sequence
  Description of Artificial Sequence: Synthetic oligonucleotide
cugagcggauccucacacg

SEQ ID NO: 12 - RNA, 19 nt, Artificial Sequence
  Description of Artificial Sequence: Synthetic oligonucleotide
ugagcggauccucacacga

SEQ ID NO: 13 - RNA, 19 nt, Artificial Sequence
  Description of Artificial Sequence: Synthetic oligonucleotide
gagcggauccucacacgac

SEQ ID NO: 14 - RNA, 19 nt, Artificial Sequence
  Description of Artificial Sequence: Synthetic oligonucleotide
agcggauccucacacgacu

SEQ ID NO: 15 - RNA, 19 nt, Artificial Sequence
  Description of Artificial Sequence: Synthetic oligonucleotide
gcggauccucacacgacug

SEQ ID NO: 16 - RNA, 19 nt, Artificial Sequence
  Description of Artificial Sequence: Synthetic oligonucleotide
cggauccucacacgacugu

SEQ ID NO: 17 - RNA, 19 nt, Artificial Sequence
  Description of Artificial Sequence: Synthetic oligonucleotide
ggauccucacacgacugug

SEQ ID NO: 18 - RNA, 19 nt, Artificial Sequence
  Description of Artificial Sequence: Synthetic oligonucleotide
gauccucacacgacuguga

SEQ ID NO: 19 - RNA, 19 nt, Artificial Sequence
  Description of Artificial Sequence: Synthetic oligonucleotide
auccucacacgacugugau

SEQ ID NO: 20 - RNA, 19 nt, Artificial Sequence
  Description of Artificial Sequence: Synthetic oligonucleotide
uccucacacgacugugauc

SEQ ID NO: 21 - RNA, 19 nt, Artificial Sequence
  Description of Artificial Sequence: Synthetic oligonucleotide
ccucacacgacugugaucc

SEQ ID NO: 22 - RNA, 19 nt, Artificial Sequence
  Description of Artificial Sequence: Synthetic oligonucleotide
cucacacgacugugauccg

SEQ ID NO: 23 - RNA, 19 nt, Artificial Sequence
  Description of Artificial Sequence: Synthetic oligonucleotide
ucacacgacugugauccga

SEQ ID NO: 24 - RNA, 19 nt, Artificial Sequence
  Description of Artificial Sequence: Synthetic oligonucleotide
cacacgacugugauccgau

SEQ ID NO: 25 - RNA, 19 nt, Artificial Sequence
  Description of Artificial Sequence: Synthetic oligonucleotide
acacgacugugauccgauu

SEQ ID NO: 26 - RNA, 19 nt, Artificial Sequence
  Description of Artificial Sequence: Synthetic oligonucleotide
cacgacugugauccgauuc

SEQ ID NO: 27 - RNA, 19 nt, Artificial Sequence
  Description of Artificial Sequence: Synthetic oligonucleotide
acgacugugauccgauucu

SEQ ID NO: 28 - RNA, 19 nt, Artificial Sequence
  Description of Artificial Sequence: Synthetic oligonucleotide
cgacugugauccgauucuu

SEQ ID NO: 29 - RNA, 19 nt, Artificial Sequence
  Description of Artificial Sequence: Synthetic oligonucleotide
gacugugauccgauucuuu

SEQ ID NO: 30 - RNA, 19 nt, Artificial Sequence
  Description of Artificial Sequence: Synthetic oligonucleotide
acugugauccgauucuuuc

SEQ ID NO: 31 - RNA, 19 nt, Artificial Sequence
  Description of Artificial Sequence: Synthetic oligonucleotide
cugugauccgauucuuucc

SEQ ID NO: 32 - RNA, 19 nt, Artificial Sequence
  Description of Artificial Sequence: Synthetic oligonucleotide
ugugauccgauucuuucca

SEQ ID NO: 33 - RNA, 19 nt, Artificial Sequence
  Description of Artificial Sequence: Synthetic oligonucleotide
gugauccgauucuuuccag

SEQ ID NO: 34 - RNA, 19 nt, Artificial Sequence
  Description of Artificial Sequence: Synthetic oligonucleotide
ugauccgauucuuuccagc

SEQ ID NO: 35 - RNA, 19 nt, Artificial Sequence
  Description of Artificial Sequence: Synthetic oligonucleotide
gauccgauucuuuccagcg

SEQ ID NO: 36 - RNA, 19 nt, Artificial Sequence
  Description of Artificial Sequence: Synthetic oligonucleotide
auccgauucuuuccagcgg

SEQ ID NO: 37 - RNA, 19 nt, Artificial Sequence
  Description of Artificial Sequence: Synthetic oligonucleotide
uccgauucuuuccagcggc

SEQ ID NO: 38 - RNA, 19 nt, Artificial Sequence
  Description of Artificial Sequence: Synthetic oligonucleotide
ccgauucuuuccagcggcu

SEQ ID NO: 39 - RNA, 19 nt, Artificial Sequence
  Description of Artificial Sequence: Synthetic oligonucleotide
cgauucuuuccagcggcuu

SEQ ID NO: 40 - RNA, 19 nt, Artificial Sequence
  Description of Artificial Sequence: Synthetic oligonucleotide
gauucuuuccagcggcuuc

SEQ ID NO: 41 - RNA, 19 nt, Artificial Sequence
  Description of Artificial Sequence: Synthetic oligonucleotide
auucuuuccagcggcuucu

SEQ ID NO: 42 - RNA, 19 nt, Artificial Sequence
  Description of Artificial Sequence: Synthetic oligonucleotide
uucuuuccagcggcuucug

SEQ ID NO: 43 - RNA, 19 nt, Artificial Sequence
  Description of Artificial Sequence: Synthetic oligonucleotide
ucuuuccagcggcuucugc

SEQ ID NO: 44 - RNA, 19 nt, Artificial Sequence
  Description of Artificial Sequence: Synthetic oligonucleotide
cuuuccagcggcuucugca

SEQ ID NO: 45 - RNA, 19 nt, Artificial Sequence
  Description of Artificial Sequence: Synthetic oligonucleotide
uuuccagcggcuucugcaa

SEQ ID NO: 46 - RNA, 19 nt, Artificial Sequence
  Description of Artificial Sequence: Synthetic oligonucleotide
uuccagcggcuucugcaac

SEQ ID NO: 47 - RNA, 19 nt, Artificial Sequence
  Description of Artificial Sequence: Synthetic oligonucleotide
uccagcggcuucugcaacc

SEQ ID NO: 48 - RNA, 19 nt, Artificial Sequence
  Description of Artificial Sequence: Synthetic oligonucleotide
ccagcggcuucugcaacca

SEQ ID NO: 49 - RNA, 19 nt, Artificial Sequence
  Description of Artificial Sequence: Synthetic oligonucleotide
cagcggcuucugcaaccaa

SEQ ID NO: 50 - RNA, 19 nt, Artificial Sequence
  Description of Artificial Sequence: Synthetic oligonucleotide
agcggcuucugcaaccaag

SEQ ID NO: 51 - RNA, 19 nt, Artificial Sequence
  Description of Artificial Sequence: Synthetic oligonucleotide
gcggcuucugcaaccaagc

SEQ ID NO: 52 - RNA, 19 nt, Artificial Sequence
  Description of Artificial Sequence: Synthetic oligonucleotide
cggcuucugcaaccaagcg

SEQ ID NO: 53 - RNA, 19 nt, Artificial Sequence
  Description of Artificial Sequence: Synthetic oligonucleotide
ggcuucugcaaccaagcgg

SEQ ID NO: 54 - RNA, 19 nt, Artificial Sequence
  Description of Artificial Sequence: Synthetic oligonucleotide
gcuucugcaaccaagcggg

SEQ ID NO: 55 - RNA, 19 nt, Artificial Sequence
  Description of Artificial Sequence: Synthetic oligonucleotide
cuucugcaaccaagcgggu

SEQ ID NO: 56 - RNA, 19 nt, Artificial Sequence
  Description of Artificial Sequence: Synthetic oligonucleotide
uucugcaaccaagcggguc

SEQ ID NO: 57 - RNA, 19 nt, Artificial Sequence
  Description of Artificial Sequence: Synthetic oligonucleotide
ucugcaaccaagcgggucu

SEQ ID NO: 58 - RNA, 19 nt, Artificial Sequence
  Description of Artificial Sequence: Synthetic oligonucleotide
cugcaaccaagcgggucuu

SEQ ID NO: 59 - RNA, 19 nt, Artificial Sequence
  Description of Artificial Sequence: Synthetic oligonucleotide
ugcaaccaagcgggucuua

SEQ ID NO: 60 - RNA, 19 nt, Artificial Sequence
  Description of Artificial Sequence: Synthetic oligonucleotide
gcaaccaagcgggucuuac

SEQ ID NO: 61 - RNA, 19 nt, Artificial Sequence
  Description of Artificial Sequence: Synthetic oligonucleotide
caaccaagcgggucuuacc

SEQ ID NO: 62 - RNA, 19 nt, Artificial Sequence
  Description of Artificial Sequence: Synthetic oligonucleotide
aaccaagcgggucuuaccc

SEQ ID NO: 63 - RNA, 19 nt, Artificial Sequence
  Description of Artificial Sequence: Synthetic oligonucleotide
accaagcgggucuuacccc

SEQ ID NO: 64 - RNA, 19 nt, Artificial Sequence
  Description of Artificial Sequence: Synthetic oligonucleotide
ccaagcgggucuuaccccc

SEQ ID NO: 65 - RNA, 19 nt, Artificial Sequence
  Description of Artificial Sequence: Synthetic oligonucleotide
caagcgggucuuacccccg

SEQ ID NO: 66 - RNA, 19 nt, Artificial Sequence
  Description of Artificial Sequence: Synthetic oligonucleotide
aagcgggucuuacccccgg

SEQ ID NO: 67 - RNA, 19 nt, Artificial Sequence
  Description of Artificial Sequence: Synthetic oligonucleotide
agcgggucuuacccccggu

SEQ ID NO: 68 - RNA, 19 nt, Artificial Sequence
  Description of Artificial Sequence: Synthetic oligonucleotide
gcgggucuuacccccgguc

SEQ ID NO: 69 - RNA, 19 nt, Artificial Sequence
  Description of Artificial Sequence: Synthetic oligonucleotide
cgggucuuacccccggucc

SEQ ID NO: 70 - RNA, 19 nt, Artificial Sequence
  Description of Artificial Sequence: Synthetic oligonucleotide
gggucuuacccccgguccu

SEQ ID NO: 71 - RNA, 19 nt, Artificial Sequence
  Description of Artificial Sequence: Synthetic oligonucleotide
ggucuuacccccgguccuc

SEQ ID NO: 72 - RNA, 19 nt, Artificial Sequence
  Description of Artificial Sequence: Synthetic oligonucleotide
gucuuacccccgguccucc

SEQ ID NO: 73 - RNA, 19 nt, Artificial Sequence
  Description of Artificial Sequence: Synthetic oligonucleotide
ucuuacccccgguccuccg

SEQ ID NO: 74 - RNA, 19 nt, Artificial Sequence
  Description of Artificial Sequence: Synthetic oligonucleotide
cuuacccccgguccuccgc

SEQ ID NO: 75 - RNA, 19 nt, Artificial Sequence
  Description of Artificial Sequence: Synthetic oligonucleotide
uuacccccgguccuccgcg

SEQ ID NO: 76 - RNA, 19 nt, Artificial Sequence
  Description of Artificial Sequence: Synthetic oligonucleotide
uacccccgguccuccgcgu

SEQ ID NO: 77 - RNA, 19 nt, Artificial Sequence
  Description of Artificial Sequence: Synthetic oligonucleotide
acccccgguccuccgcguc

SEQ ID NO: 78 - RNA, 19 nt, Artificial Sequence
  Description of Artificial Sequence: Synthetic oligonucleotide
cccccgguccuccgcgucu

SEQ ID NO: 79 - RNA, 19 nt, Artificial Sequence
  Description of Artificial Sequence: Synthetic oligonucleotide
ccccgguccuccgcgucuc

SEQ ID NO: 80 - RNA, 19 nt, Artificial Sequence
  Description of Artificial Sequence: Synthetic oligonucleotide
cccgguccuccgcgucucc

SEQ ID NO: 81 - RNA, 19 nt, Artificial Sequence
  Description of Artificial Sequence: Synthetic oligonucleotide
ccgguccuccgcgucucca

SEQ ID NO: 82 - RNA, 19 nt, Artificial Sequence
  Description of Artificial Sequence: Synthetic oligonucleotide
cgguccuccgcgucuccag

SEQ ID NO: 83 - RNA, 19 nt, Artificial Sequence
  Description of Artificial Sequence: Synthetic oligonucleotide
gguccuccgcgucuccagu

SEQ ID NO: 84 - RNA, 19 nt, Artificial Sequence
  Description of Artificial Sequence: Synthetic oligonucleotide
guccuccgcgucuccaguc

SEQ ID NO: 85 - RNA, 19 nt, Artificial Sequence
  Description of Artificial Sequence: Synthetic oligonucleotide
uccuccgcgucuccagucc

SEQ ID NO: 86 - RNA, 19 nt, Artificial Sequence
  Description of Artificial Sequence: Synthetic oligonucleotide
ccuccgcgucuccaguccu

SEQ ID NO: 87 - RNA, 19 nt, Artificial Sequence
  Description of Artificial Sequence: Synthetic oligonucleotide
cuccgcgucuccaguccuc

SEQ ID NO: 88 - RNA, 19 nt, Artificial Sequence
  Description of Artificial Sequence: Synthetic oligonucleotide
uccgcgucuccaguccucg

SEQ ID NO: 89 - RNA, 19 nt, Artificial Sequence
  Description of Artificial Sequence: Synthetic oligonucleotide
ccgcgucuccaguccucgc

SEQ ID NO: 90 - RNA, 19 nt, Artificial Sequence
  Description of Artificial Sequence: Synthetic oligonucleotide
cgcgucuccaguccucgca

SEQ ID NO: 91 - RNA, 19 nt, Artificial Sequence
  Description of Artificial Sequence: Synthetic oligonucleotide
gcgucuccaguccucgcac

SEQ ID NO: 92 - RNA, 19 nt, Artificial Sequence
  Description of Artificial Sequence: Synthetic oligonucleotide
cgucuccaguccucgcacc

SEQ ID NO: 93 - RNA, 19 nt, Artificial Sequence
  Description of Artificial Sequence: Synthetic oligonucleotide
gucuccaguccucgcaccu

SEQ ID NO: 94 - RNA, 19 nt, Artificial Sequence
  Description of Artificial Sequence: Synthetic oligonucleotide
ucuccaguccucgcaccug

SEQ ID NO: 95 - RNA, 19 nt, Artificial Sequence
  Description of Artificial Sequence: Synthetic oligonucleotide
cuccaguccucgcaccugg

SEQ ID NO: 96 - RNA, 19 nt, Artificial Sequence
  Description of Artificial Sequence: Synthetic oligonucleotide
uccaguccucgcaccugga

SEQ ID NO: 97 - RNA, 19 nt, Artificial Sequence
  Description of Artificial Sequence: Synthetic oligonucleotide
ccaguccucgcaccuggaa

SEQ ID NO: 98 - RNA, 19 nt, Artificial Sequence
  Description of Artificial Sequence: Synthetic oligonucleotide
caguccucgcaccuggaac

SEQ ID NO: 99 - RNA, 19 nt, Artificial Sequence
  Description of Artificial Sequence: Synthetic oligonucleotide
aguccucgcaccuggaacc

SEQ ID NO: 100 - RNA, 19 nt, Artificial Sequence
  Description of Artificial Sequence: Synthetic oligonucleotide
guccucgcaccuggaaccc

SEQ ID NO: 101 - RNA, 19 nt, Artificial Sequence
  Description of Artificial Sequence: Synthetic oligonucleotide
uccucgcaccuggaacccc

SEQ ID NO: 102 - RNA, 19 nt, Artificial Sequence
  Description of Artificial Sequence: Synthetic oligonucleotide
ccucgcaccuggaacccca

SEQ ID NO: 103 - RNA, 19 nt, Artificial Sequence
  Description of Artificial Sequence: Synthetic oligonucleotide
cucgcaccuggaaccccaa

SEQ ID NO: 104 - RNA, 19 nt, Artificial Sequence
  Description of Artificial Sequence: Synthetic oligonucleotide
ucgcaccuggaaccccaac

SEQ ID NO: 105 - RNA, 19 nt, Artificial Sequence
  Description of Artificial Sequence: Synthetic oligonucleotide
cgcaccuggaaccccaacg

SEQ ID NO: 106 - RNA, 19 nt, Artificial Sequence
  Description of Artificial Sequence: Synthetic oligonucleotide
gcaccuggaaccccaacgu

SEQ ID NO: 107 - RNA, 19 nt, Artificial Sequence
  Description of Artificial Sequence: Synthetic oligonucleotide
caccuggaaccccaacguc

SEQ ID NO: 108 - RNA, 19 nt, Artificial Sequence
  Description of Artificial Sequence: Synthetic oligonucleotide
accuggaaccccaacgucc

SEQ ID NO: 109 - RNA, 19 nt, Artificial Sequence
  Description of Artificial Sequence: Synthetic oligonucleotide
ccuggaaccccaacguccc

SEQ ID NO: 110 - RNA, 19 nt, Artificial Sequence
  Description of Artificial Sequence: Synthetic oligonucleotide
cuggaaccccaacgucccc

SEQ ID NO: 111 - RNA, 19 nt, Artificial Sequence
  Description of Artificial Sequence: Synthetic oligonucleotide
uggaaccccaacguccccg

SEQ ID NO: 112 - RNA, 19 nt, Artificial Sequence
  Description of Artificial Sequence: Synthetic oligonucleotide
ggaaccccaacguccccga

SEQ ID NO: 113 - RNA, 19 nt, Artificial Sequence
  Description of Artificial Sequence: Synthetic oligonucleotide
gaaccccaacguccccgag

SEQ ID NO: 114 - RNA, 19 nt, Artificial Sequence
  Description of Artificial Sequence: Synthetic oligonucleotide
aaccccaacguccccgaga

SEQ ID NO: 115 - RNA, 19 nt, Artificial Sequence
  Description of Artificial Sequence: Synthetic oligonucleotide
accccaacguccccgagag

SEQ ID NO: 116 - RNA, 19 nt, Artificial Sequence
  Description of Artificial Sequence: Synthetic oligonucleotide
ccccaacguccccgagagu

SEQ ID NO: 117 - RNA, 19 nt, Artificial Sequence
  Description of Artificial Sequence: Synthetic oligonucleotide
cccaacguccccgagaguc

SEQ ID NO: 118 - RNA, 19 nt, Artificial Sequence
  Description of Artificial Sequence: Synthetic oligonucleotide
ccaacguccccgagagucc

SEQ ID NO: 119 - RNA, 19 nt, Artificial Sequence
  Description of Artificial Sequence: Synthetic oligonucleotide
caacguccccgagaguccc

SEQ ID NO: 120 - RNA, 19 nt, Artificial Sequence
  Description of Artificial Sequence: Synthetic oligonucleotide
aacguccccgagagucccc

SEQ ID NO: 121 - RNA, 19 nt, Artificial Sequence
  Description of Artificial Sequence: Synthetic oligonucleotide
acguccccgagaguccccg

SEQ ID NO: 122 - RNA, 19 nt, Artificial Sequence
  Description of Artificial Sequence: Synthetic oligonucleotide
cguccccgagaguccccga

SEQ ID NO: 123 - RNA, 19 nt, Artificial Sequence
  Description of Artificial Sequence: Synthetic oligonucleotide
guccccgagaguccccgaa

SEQ ID NO: 124 - RNA, 19 nt, Artificial Sequence
  Description of Artificial Sequence: Synthetic oligonucleotide
uccccgagaguccccgaau

SEQ ID NO: 125 - RNA, 19 nt, Artificial Sequence
  Description of Artificial Sequence: Synthetic oligonucleotide
ccccgagaguccccgaauc

SEQ ID NO: 126 - RNA, 19 nt, Artificial Sequence
  Description of Artificial Sequence: Synthetic oligonucleotide
cccgagaguccccgaaucc

SEQ ID NO: 127 - RNA, 19 nt, Artificial Sequence
  Description of Artificial Sequence: Synthetic oligonucleotide
ccgagaguccccgaauccc

SEQ ID NO: 128 - RNA, 19 nt, Artificial Sequence
  Description of Artificial Sequence: Synthetic oligonucleotide
cgagaguccccgaaucccc

SEQ ID NO: 129 - RNA, 19 nt, Artificial Sequence
  Description of Artificial Sequence: Synthetic oligonucleotide
gagaguccccgaauccccg

SEQ ID NO: 130 - RNA, 19 nt, Artificial Sequence
  Description of Artificial Sequence: Synthetic oligonucleotide
agaguccccgaauccccgc

SEQ ID NO: 131 - RNA, 19 nt, Artificial Sequence
  Description of Artificial Sequence: Synthetic oligonucleotide
gaguccccgaauccccgcu

SEQ ID NO: 132 - RNA, 19 nt, Artificial Sequence
  Description of Artificial Sequence: Synthetic oligonucleotide
aguccccgaauccccgcuc

SEQ ID NO: 133 - RNA, 19 nt, Artificial Sequence
  Description of Artificial Sequence: Synthetic oligonucleotide
guccccgaauccccgcucc

SEQ ID NO: 134 - RNA, 19 nt, Artificial Sequence
  Description of Artificial Sequence: Synthetic oligonucleotide
uccccgaauccccgcuccc

SEQ ID NO: 135 - RNA, 19 nt, Artificial Sequence
  Description of Artificial Sequence: Synthetic oligonucleotide
ccccgaauccccgcuccca

SEQ ID NO: 136 - RNA, 19 nt, Artificial Sequence
  Description of Artificial Sequence: Synthetic oligonucleotide
cccgaauccccgcucccag

SEQ ID NO: 137 - RNA, 19 nt, Artificial Sequence
  Description of Artificial Sequence: Synthetic oligonucleotide
ccgaauccccgcucccagg

SEQ ID NO: 138 - RNA, 19 nt, Artificial Sequence
  Description of Artificial Sequence: Synthetic oligonucleotide
cgaauccccgcucccaggc

SEQ ID NO: 139 - RNA, 19 nt, Artificial Sequence
  Description of Artificial Sequence: Synthetic oligonucleotide
gaauccccgcucccaggcu

SEQ ID NO: 140 - RNA, 19 nt, Artificial Sequence
  Description of Artificial Sequence: Synthetic oligonucleotide
aauccccgcucccaggcua

SEQ ID NO: 141 - RNA, 19 nt, Artificial Sequence
  Description of Artificial Sequence: Synthetic oligonucleotide
auccccgcucccaggcuac

SEQ ID NO: 142 - RNA, 19 nt, Artificial Sequence
  Description of Artificial Sequence: Synthetic oligonucleotide
uccccgcucccaggcuacc

SEQ ID NO: 143 - RNA, 19 nt, Artificial Sequence
  Description of Artificial Sequence: Synthetic oligonucleotide
ccccgcucccaggcuaccu

SEQ ID NO: 144 - RNA, 19 nt, Artificial Sequence
  Description of Artificial Sequence: Synthetic oligonucleotide
cccgcucccaggcuaccua

SEQ ID NO: 145 - RNA, 19 nt, Artificial Sequence
  Description of Artificial Sequence: Synthetic oligonucleotide
ccgcucccaggcuaccuaa

SEQ ID NO: 146 - RNA, 19 nt, Artificial Sequence
  Description of Artificial Sequence: Synthetic oligonucleotide
cgcucccaggcuaccuaag

SEQ ID NO: 147 - RNA, 19 nt, Artificial Sequence
  Description of Artificial Sequence: Synthetic oligonucleotide
gcucccaggcuaccuaaga

SEQ ID NO: 148 - RNA, 19 nt, Artificial Sequence
  Description of Artificial Sequence: Synthetic oligonucleotide
cucccaggcuaccuaagag

SEQ ID NO: 149 - RNA, 19 nt, Artificial Sequence
  Description of Artificial Sequence: Synthetic oligonucleotide
ucccaggcuaccuaagagg

SEQ ID NO: 150 - RNA, 19 nt, Artificial Sequence
  Description of Artificial Sequence: Synthetic oligonucleotide
cccaggcuaccuaagagga

SEQ ID NO: 151 - RNA, 19 nt, Artificial Sequence
  Description of Artificial Sequence: Synthetic oligonucleotide
ccaggcuaccuaagaggau

SEQ ID NO: 152 - RNA, 19 nt, Artificial Sequence
  Description of Artificial Sequence: Synthetic oligonucleotide
caggcuaccuaagaggaug

SEQ ID NO: 153 - RNA, 19 nt, Artificial Sequence
  Description of Artificial Sequence: Synthetic oligonucleotide
aggcuaccuaagaggauga

SEQ ID NO: 154 - RNA, 19 nt, Artificial Sequence
  Description of Artificial Sequence: Synthetic oligonucleotide
ggcuaccuaagaggaugag

SEQ ID NO: 155 - RNA, 19 nt, Artificial Sequence
  Description of Artificial Sequence: Synthetic oligonucleotide
gcuaccuaagaggaugagc

SEQ ID NO: 156 - RNA, 19 nt, Artificial Sequence
  Description of Artificial Sequence: Synthetic oligonucleotide
cuaccuaagaggaugagcg

SEQ ID NO: 157 - RNA, 19 nt, Artificial Sequence
  Description of Artificial Sequence: Synthetic oligonucleotide
uaccuaagaggaugagcgg

SEQ ID NO: 158 - RNA, 19 nt, Artificial Sequence
  Description of Artificial Sequence: Synthetic oligonucleotide
accuaagaggaugagcggu

SEQ ID NO: 159 - RNA, 19 nt, Artificial Sequence
  Description of Artificial Sequence: Synthetic oligonucleotide
ccuaagaggaugagcggug

SEQ ID NO: 160 - RNA, 19 nt, Artificial Sequence
  Description of Artificial Sequence: Synthetic oligonucleotide
cuaagaggaugagcggugc

SEQ ID NO: 161 - RNA, 19 nt, Artificial Sequence
  Description of Artificial Sequence: Synthetic oligonucleotide
uaagaggaugagcggugcu

SEQ ID NO: 162 - RNA, 19 nt, Artificial Sequence
  Description of Artificial Sequence: Synthetic oligonucleotide
aagaggaugagcggugcuc

SEQ ID NO: 163 - RNA, 19 nt, Artificial Sequence
  Description of Artificial Sequence: Synthetic oligonucleotide
agaggaugagcggugcucc

SEQ ID NO: 164 - RNA, 19 nt, Artificial Sequence
  Description of Artificial Sequence: Synthetic oligonucleotide
gaggaugagcggugcuccg

SEQ ID NO: 165 - RNA, 19 nt, Artificial Sequence
  Description of Artificial Sequence: Synthetic oligonucleotide
aggaugagcggugcuccga

SEQ ID NO: 166 - RNA, 19 nt, Artificial Sequence
  Description of Artificial Sequence: Synthetic oligonucleotide
ggaugagcggugcuccgac

SEQ ID NO: 167 - RNA, 19 nt, Artificial Sequence
  Description of Artificial Sequence: Synthetic oligonucleotide
gaugagcggugcuccgacg

SEQ ID NO: 168 - RNA, 19 nt, Artificial Sequence
  Description of Artificial Sequence: Synthetic oligonucleotide
augagcggugcuccgacgg

SEQ ID NO: 169 - RNA, 19 nt, Artificial Sequence
  Description of Artificial Sequence: Synthetic oligonucleotide
ugagcggugcuccgacggc

SEQ ID NO: 170 - RNA, 19 nt, Artificial Sequence
  Description of Artificial Sequence: Synthetic oligonucleotide
gagcggugcuccgacggcc

SEQ ID NO: 171 - RNA, 19 nt, Artificial Sequence
  Description of Artificial Sequence: Synthetic oligonucleotide
agcggugcuccgacggccg

SEQ ID NO: 172 - RNA, 19 nt, Artificial Sequence
  Description of Artificial Sequence: Synthetic oligonucleotide
gcggugcuccgacggccgg

SEQ ID NO: 173 - RNA, 19 nt, Artificial Sequence
  Description of Artificial Sequence: Synthetic oligonucleotide
cggugcuccgacggccggg

SEQ ID NO: 174 - RNA, 19 nt, Artificial Sequence
  Description of Artificial Sequence: Synthetic oligonucleotide
ggugcuccgacggccgggg

SEQ ID NO: 175 - RNA, 19 nt, Artificial Sequence
  Description of Artificial Sequence: Synthetic oligonucleotide
gugcuccgacggccggggc

SEQ ID NO: 176 - RNA, 19 nt, Artificial Sequence
  Description of Artificial Sequence: Synthetic oligonucleotide
ugcuccgacggccggggca

SEQ ID NO: 177 - RNA, 19 nt, Artificial Sequence
  Description of Artificial Sequence: Synthetic oligonucleotide
gcuccgacggccggggcag

SEQ ID NO: 178 - RNA, 19 nt, Artificial Sequence
  Description of Artificial Sequence: Synthetic oligonucleotide
cuccgacggccggggcagc

SEQ ID NO: 179 - RNA, 19 nt, Artificial Sequence
  Description of Artificial Sequence: Synthetic oligonucleotide
uccgacggccggggcagcc

SEQ ID NO: 180 - RNA, 19 nt, Artificial Sequence
  Description of Artificial Sequence: Synthetic oligonucleotide
ccgacggccggggcagccc

SEQ ID NO: 181 - RNA, 19 nt, Artificial Sequence
  Description of Artificial Sequence: Synthetic oligonucleotide
cgacggccggggcagcccu

SEQ ID NO: 182 - RNA, 19 nt, Artificial Sequence
  Description of Artificial Sequence: Synthetic oligonucleotide
gacggccggggcagcccug

SEQ ID NO: 183 - RNA, 19 nt, Artificial Sequence
  Description of Artificial Sequence: Synthetic oligonucleotide
acggccggggcagcccuga

SEQ ID NO: 184 - RNA, 19 nt, Artificial Sequence
  Description of Artificial Sequence: Synthetic oligonucleotide
cggccggggcagcccugau

SEQ ID NO: 185 - RNA, 19 nt, Artificial Sequence
  Description of Artificial Sequence: Synthetic oligonucleotide
ggccggggcagcccugaug

SEQ ID NO: 186 - RNA, 19 nt, Artificial Sequence
  Description of Artificial Sequence: Synthetic oligonucleotide
gccggggcagcccugaugc

SEQ ID NO: 187 - RNA, 19 nt, Artificial Sequence
  Description of Artificial Sequence: Synthetic oligonucleotide
ccggggcagcccugaugcu

SEQ ID NO: 188 - RNA, 19 nt, Artificial Sequence
  Description of Artificial Sequence: Synthetic oligonucleotide
cggggcagcccugaugcuc

SEQ ID NO: 189 - RNA, 19 nt, Artificial Sequence
  Description of Artificial Sequence: Synthetic oligonucleotide
ggggcagcccugaugcucu

SEQ ID NO: 190 - RNA, 19 nt, Artificial Sequence
  Description of Artificial Sequence: Synthetic oligonucleotide
gggcagcccugaugcucug

SEQ ID NO: 191 - RNA, 19 nt, Artificial Sequence
  Description of Artificial Sequence: Synthetic oligonucleotide
ggcagcccugaugcucugc

SEQ ID NO: 192 - RNA, 19 nt, Artificial Sequence
  Description of Artificial Sequence: Synthetic oligonucleotide
gcagcccugaugcucugcg

SEQ ID NO: 193 - RNA, 19 nt, Artificial Sequence
  Description of Artificial Sequence: Synthetic oligonucleotide
cagcccugaugcucugcgc

SEQ ID NO: 194 - RNA, 19 nt, Artificial Sequence
  Description of Artificial Sequence: Synthetic oligonucleotide
agcccugaugcucugcgcc

SEQ ID NO: 195 - RNA, 19 nt, Artificial Sequence
  Description of Artificial Sequence: Synthetic oligonucleotide
gcccugaugcucugcgccg

SEQ ID NO: 196 - RNA, 19 nt, Artificial Sequence
  Description of Artificial Sequence: Synthetic oligonucleotide
cccugaugcucugcgccgc

SEQ ID NO: 197 - RNA, 19 nt, Artificial Sequence
  Description of Artificial Sequence: Synthetic oligonucleotide
ccugaugcucugcgccgcc

SEQ ID NO: 198 - RNA, 19 nt, Artificial Sequence
  Description of Artificial Sequence: Synthetic oligonucleotide
cugaugcucugcgccgcca

SEQ ID NO: 199 - RNA, 19 nt, Artificial Sequence
  Description of Artificial Sequence: Synthetic oligonucleotide
ugaugcucugcgccgccac

SEQ ID NO: 200 - RNA, 19 nt, Artificial Sequence
  Description of Artificial Sequence: Synthetic oligonucleotide
gaugcucugcgccgccacc

SEQ ID NO: 201 - RNA, 19 nt, Artificial Sequence
  Description of Artificial Sequence: Synthetic oligonucleotide
augcucugcgccgccaccg

SEQ ID NO: 202 - RNA, 19 nt, Artificial Sequence
  Description of Artificial Sequence: Synthetic oligonucleotide
ugcucugcgccgccaccgc

SEQ ID NO: 203 - RNA, 19 nt, Artificial Sequence
  Description of Artificial Sequence: Synthetic oligonucleotide
gcucugcgccgccaccgcc

SEQ ID NO: 204 - RNA, 19 nt, Artificial Sequence
  Description of Artificial Sequence: Synthetic oligonucleotide
cucugcgccgccaccgccg

SEQ ID NO: 205 - RNA, 19 nt, Artificial Sequence
  Description of Artificial Sequence: Synthetic oligonucleotide
ucugcgccgccaccgccgu

SEQ ID NO: 206 - RNA, 19 nt, Artificial Sequence
  Description of Artificial Sequence: Synthetic oligonucleotide
cugcgccgccaccgccgug

SEQ ID NO: 207 - RNA, 19 nt, Artificial Sequence
  Description of Artificial Sequence: Synthetic oligonucleotide
ugcgccgccaccgccgugc

SEQ ID NO: 208 - RNA, 19 nt, Artificial Sequence
  Description of Artificial Sequence: Synthetic oligonucleotide
gcgccgccaccgccgugcu

SEQ ID NO: 209 - RNA, 19 nt, Artificial Sequence
  Description of Artificial Sequence: Synthetic oligonucleotide
cgccgccaccgccgugcua

SEQ ID NO: 210 - RNA, 19 nt, Artificial Sequence
  Description of Artificial Sequence: Synthetic oligonucleotide
gccgccaccgccgugcuac

SEQ ID NO: 211 - RNA, 19 nt, Artificial Sequence
  Description of Artificial Sequence: Synthetic oligonucleotide
ccgccaccgccgugcuacu

SEQ ID NO: 212 - RNA, 19 nt, Artificial Sequence
  Description of Artificial Sequence: Synthetic oligonucleotide
cgccaccgccgugcuacug

SEQ ID NO: 213 - RNA, 19 nt, Artificial Sequence
  Description of Artificial Sequence: Synthetic oligonucleotide
gccaccgccgugcuacuga

SEQ ID NO: 214 - RNA, 19 nt, Artificial Sequence
  Description of Artificial Sequence: Synthetic oligonucleotide
ccaccgccgugcuacugag

SEQ ID NO: 215 - RNA, 19 nt, Artificial Sequence
  Description of Artificial Sequence: Synthetic oligonucleotide
caccgccgugcuacugagc

SEQ ID NO: 216 - RNA, 19 nt, Artificial Sequence
  Description of Artificial Sequence: Synthetic oligonucleotide
accgccgugcuacugagcg

SEQ ID NO: 217 - RNA, 19 nt, Artificial Sequence
  Description of Artificial Sequence: Synthetic oligonucleotide
ccgccgugcuacugagcgc

SEQ ID NO: 218 - RNA, 19 nt, Artificial Sequence
  Description of Artificial Sequence: Synthetic oligonucleotide
cgccgugcuacugagcgcu

SEQ ID NO: 219 - RNA, 19 nt, Artificial Sequence
  Description of Artificial Sequence: Synthetic oligonucleotide
gccgugcuacugagcgcuc

SEQ ID NO: 220 - RNA, 19 nt, Artificial Sequence
  Description of Artificial Sequence: Synthetic oligonucleotide
ccgugcuacugagcgcuca

SEQ ID NO: 221 - RNA, 19 nt, Artificial Sequence
  Description of Artificial Sequence: Synthetic oligonucleotide
cgugcuacugagcgcucag

SEQ ID NO: 222 - RNA, 19 nt, Artificial Sequence
  Description of Artificial Sequence: Synthetic oligonucleotide
gugcuacugagcgcucagg

SEQ ID NO: 223 - RNA, 19 nt, Artificial Sequence
  Description of Artificial Sequence: Synthetic oligonucleotide
ugcuacugagcgcucaggg

SEQ ID NO: 224 - RNA, 19 nt, Artificial Sequence
  Description of Artificial Sequence: Synthetic oligonucleotide
gcuacugagcgcucagggc

SEQ ID NO: 225 - RNA, 19 nt, Artificial Sequence
  Description of Artificial Sequence: Synthetic oligonucleotide
cuacugagcgcucagggcg

SEQ ID NO: 226 - RNA, 19 nt, Artificial Sequence
  Description of Artificial Sequence: Synthetic oligonucleotide
uacugagcgcucagggcgg

SEQ ID NO: 227 - RNA, 19 nt, Artificial Sequence
  Description of Artificial Sequence: Synthetic oligonucleotide
acugagcgcucagggcgga

SEQ ID NO: 228 - RNA, 19 nt, Artificial Sequence
  Description of Artificial Sequence: Synthetic oligonucleotide
cugagcgcucagggcggac

SEQ ID NO: 229 - RNA, 19 nt, Artificial Sequence
  Description of Artificial Sequence: Synthetic oligonucleotide
ugagcgcucagggcggacc

SEQ ID NO: 230 - RNA, 19 nt, Artificial Sequence
  Description of Artificial Sequence: Synthetic oligonucleotide
gagcgcucagggcggaccc

SEQ ID NO: 231 - RNA, 19 nt, Artificial Sequence
  Description of Artificial Sequence: Synthetic oligonucleotide
agcgcucagggcggacccg

SEQ ID NO: 232 - RNA, 19 nt, Artificial Sequence
  Description of Artificial Sequence: Synthetic oligonucleotide
gcgcucagggcggacccgu

SEQ ID NO: 233 - RNA, 19 nt, Artificial Sequence
  Description of Artificial Sequence: Synthetic oligonucleotide
cgcucagggcggacccgug

SEQ ID NO: 234 - RNA, 19 nt, Artificial Sequence
  Description of Artificial Sequence: Synthetic oligonucleotide
gcucagggcggacccgugc

SEQ ID NO: 235 - RNA, 19 nt, Artificial Sequence
  Description of Artificial Sequence: Synthetic oligonucleotide
cucagggcggacccgugca

SEQ ID NO: 236 - RNA, 19 nt, Artificial Sequence
  Description of Artificial Sequence: Synthetic oligonucleotide
ucagggcggacccgugcag

SEQ ID NO: 237 - RNA, 19 nt, Artificial Sequence
  Description of Artificial Sequence: Synthetic oligonucleotide
cagggcggacccgugcagu

SEQ ID NO: 238 - RNA, 19 nt, Artificial Sequence
  Description of Artificial Sequence: Synthetic oligonucleotide
agggcggacccgugcaguc

SEQ ID NO: 239 - RNA, 19 nt, Artificial Sequence
  Description of Artificial Sequence: Synthetic oligonucleotide
gggcggacccgugcagucc

SEQ ID NO: 240 - RNA, 19 nt, Artificial Sequence
  Description of Artificial Sequence: Synthetic oligonucleotide
ggcggacccgugcagucca

SEQ ID NO: 241 - RNA, 19 nt, Artificial Sequence
  Description of Artificial Sequence: Synthetic oligonucleotide
gcggacccgugcaguccaa

SEQ ID NO: 242 - RNA, 19 nt, Artificial Sequence
  Description of Artificial Sequence: Synthetic oligonucleotide
cggacccgugcaguccaag

SEQ ID NO: 243 - RNA, 19 nt, Artificial Sequence
  Description of Artificial Sequence: Synthetic oligonucleotide
ggacccgugcaguccaagu

SEQ ID NO: 244 - RNA, 19 nt, Artificial Sequence
  Description of Artificial Sequence: Synthetic oligonucleotide
gacccgugcaguccaaguc

SEQ ID NO: 245 - RNA, 19 nt, Artificial Sequence
  Description of Artificial Sequence: Synthetic oligonucleotide
acccgugcaguccaagucg

SEQ ID NO: 246 - RNA, 19 nt, Artificial Sequence
  Description of Artificial Sequence: Synthetic oligonucleotide
cccgugcaguccaagucgc

SEQ ID NO: 247 - RNA, 19 nt, Artificial Sequence
  Description of Artificial Sequence: Synthetic oligonucleotide
ccgugcaguccaagucgcc

SEQ ID NO: 248 - RNA, 19 nt, Artificial Sequence
  Description of Artificial Sequence: Synthetic oligonucleotide
cgugcaguccaagucgccg

SEQ ID NO: 249 - RNA, 19 nt, Artificial Sequence
  Description of Artificial Sequence: Synthetic oligonucleotide
gugcaguccaagucgccgc

SEQ ID NO: 250 - RNA, 19 nt, Artificial Sequence
  Description of Artificial Sequence: Synthetic oligonucleotide
ugcaguccaagucgccgcg

SEQ ID NO: 251 - RNA, 19 nt, Artificial Sequence
  Description of Artificial Sequence: Synthetic oligonucleotide
gcaguccaagucgccgcgc

SEQ ID NO: 252 - RNA, 19 nt, Artificial Sequence
  Description of Artificial Sequence: Synthetic oligonucleotide
caguccaagucgccgcgcu

SEQ ID NO: 253 - RNA, 19 nt, Artificial Sequence
  Description of Artificial Sequence: Synthetic oligonucleotide
aguccaagucgccgcgcuu

SEQ ID NO: 254 - RNA, 19 nt, Artificial Sequence
  Description of Artificial Sequence: Synthetic oligonucleotide
guccaagucgccgcgcuuu

SEQ ID NO: 255 - RNA, 19 nt, Artificial Sequence
  Description of Artificial Sequence: Synthetic oligonucleotide
uccaagucgccgcgcuuug

SEQ ID NO: 256 - RNA, 19 nt, Artificial Sequence
  Description of Artificial Sequence: Synthetic oligonucleotide
ccaagucgccgcgcuuugc

SEQ ID NO: 257 - RNA, 19 nt, Artificial Sequence
  Description of Artificial Sequence: Synthetic oligonucleotide
caagucgccgcgcuuugcg

SEQ ID NO: 258 - RNA, 19 nt, Artificial Sequence
  Description of Artificial Sequence: Synthetic oligonucleotide
aagucgccgcgcuuugcgu

SEQ ID NO: 259 - RNA, 19 nt, Artificial Sequence
  Description of Artificial Sequence: Synthetic oligonucleotide
agucgccgcgcuuugcguc

SEQ ID NO: 260 - RNA, 19 nt, Artificial Sequence
  Description of Artificial Sequence: Synthetic oligonucleotide
gucgccgcgcuuugcgucc

SEQ ID NO: 261 - RNA, 19 nt, Artificial Sequence
  Description of Artificial Sequence: Synthetic oligonucleotide
ucgccgcgcuuugcguccu

SEQ ID NO: 262 - RNA, 19 nt, Artificial Sequence
  Description of Artificial Sequence: Synthetic oligonucleotide
cgccgcgcuuugcguccug

SEQ ID NO: 263 - RNA, 19 nt, Artificial Sequence
  Description of Artificial Sequence: Synthetic oligonucleotide
gccgcgcuuugcguccugg

SEQ ID NO: 264 - RNA, 19 nt, Artificial Sequence
  Description of Artificial Sequence: Synthetic oligonucleotide
ccgcgcuuugcguccuggg

SEQ ID NO: 265 - RNA, 19 nt, Artificial Sequence
  Description of Artificial Sequence: Synthetic oligonucleotide
cgcgcuuugcguccuggga

SEQ ID NO: 266 - RNA, 19 nt, Artificial Sequence
  Description of Artificial Sequence: Synthetic oligonucleotide
gcgcuuugcguccugggac

SEQ ID NO: 267 - RNA, 19 nt, Artificial Sequence
  Description of Artificial Sequence: Synthetic oligonucleotide
cgcuuugcguccugggacg

SEQ ID NO: 268 - RNA, 19 nt, Artificial Sequence
  Description of Artificial Sequence: Synthetic oligonucleotide
gcuuugcguccugggacga

SEQ ID NO: 269 - RNA, 19 nt, Artificial Sequence
  Description of Artificial Sequence: Synthetic oligonucleotide
cuuugcguccugggacgag

SEQ ID NO: 270 - RNA, 19 nt, Artificial Sequence
  Description of Artificial Sequence: Synthetic oligonucleotide
uuugcguccugggacgaga

SEQ ID NO: 271 - RNA, 19 nt, Artificial Sequence
  Description of Artificial Sequence: Synthetic oligonucleotide
uugcguccugggacgagau

SEQ ID NO: 272 - RNA, 19 nt, Artificial Sequence
  Description of Artificial Sequence: Synthetic oligonucleotide
ugcguccugggacgagaug

SEQ ID NO: 273 - RNA, 19 nt, Artificial Sequence
  Description of Artificial Sequence: Synthetic oligonucleotide
gcguccugggacgagauga

SEQ ID NO: 274 - RNA, 19 nt, Artificial Sequence
  Description of Artificial Sequence: Synthetic oligonucleotide
cguccugggacgagaugaa

SEQ ID NO: 275 - RNA, 19 nt, Artificial Sequence
  Description of Artificial Sequence: Synthetic oligonucleotide
guccugggacgagaugaau

SEQ ID NO: 276 - RNA, 19 nt, Artificial Sequence
  Description of Artificial Sequence: Synthetic oligonucleotide
uccugggacgagaugaaug

SEQ ID NO: 277 - RNA, 19 nt, Artificial Sequence
  Description of Artificial Sequence: Synthetic oligonucleotide
ccugggacgagaugaaugu

SEQ ID NO: 278 - RNA, 19 nt, Artificial Sequence
  Description of Artificial Sequence: Synthetic oligonucleotide
cugggacgagaugaauguc

SEQ ID NO: 279 - RNA, 19 nt, Artificial Sequence
  Description of Artificial Sequence: Synthetic oligonucleotide
ugggacgagaugaaugucc

SEQ ID NO: 280 - RNA, 19 nt, Artificial Sequence
  Description of Artificial Sequence: Synthetic oligonucleotide
gggacgagaugaauguccu

SEQ ID NO: 281 - RNA, 19 nt, Artificial Sequence
  Description of Artificial Sequence: Synthetic oligonucleotide
ggacgagaugaauguccug

SEQ ID NO: 282 - RNA, 19 nt, Artificial Sequence
  Description of Artificial Sequence: Synthetic oligonucleotide
gacgagaugaauguccugg

SEQ ID NO: 283 - RNA, 19 nt, Artificial Sequence
  Description of Artificial Sequence: Synthetic oligonucleotide
acgagaugaauguccuggc

SEQ ID NO: 284 - RNA, 19 nt, Artificial Sequence
  Description of Artificial Sequence: Synthetic oligonucleotide
cgagaugaauguccuggcg

SEQ ID NO: 285 - RNA, 19 nt, Artificial Sequence
  Description of Artificial Sequence: Synthetic oligonucleotide
gagaugaauguccuggcgc

SEQ ID NO: 286 - RNA, 19 nt, Artificial Sequence
  Description of Artificial Sequence: Synthetic oligonucleotide
agaugaauguccuggcgca

SEQ ID NO: 287 - RNA, 19 nt, Artificial Sequence
  Description of Artificial Sequence: Synthetic oligonucleotide
gaugaauguccuggcgcac

SEQ ID NO: 288 - RNA, 19 nt, Artificial Sequence
  Description of Artificial Sequence: Synthetic oligonucleotide
augaauguccuggcgcacg

SEQ ID NO: 289 - RNA, 19 nt, Artificial Sequence
  Description of Artificial Sequence: Synthetic oligonucleotide
ugaauguccuggcgcacgg

SEQ ID NO: 290 - RNA, 19 nt, Artificial Sequence
  Description of Artificial Sequence: Synthetic oligonucleotide
gaauguccuggcgcacgga

SEQ ID NO: 291 - RNA, 19 nt, Artificial Sequence
  Description of Artificial Sequence: Synthetic oligonucleotide
aauguccuggcgcacggac

SEQ ID NO: 292 - RNA, 19 nt, Artificial Sequence
  Description of Artificial Sequence: Synthetic oligonucleotide
auguccuggcgcacggacu

SEQ ID NO: 293 - RNA, 19 nt, Artificial Sequence
  Description of Artificial Sequence: Synthetic oligonucleotide
uguccuggcgcacggacuc

SEQ ID NO: 294 - RNA, 19 nt, Artificial Sequence
  Description of Artificial Sequence: Synthetic oligonucleotide
guccuggcgcacggacucc

SEQ ID NO: 295 - RNA, 19 nt, Artificial Sequence
  Description of Artificial Sequence: Synthetic oligonucleotide
uccuggcgcacggacuccu

SEQ ID NO: 296 - RNA, 19 nt, Artificial Sequence
  Description of Artificial Sequence: Synthetic oligonucleotide
ccuggcgcacggacuccug

SEQ ID NO: 297 - RNA, 19 nt, Artificial Sequence
  Description of Artificial Sequence: Synthetic oligonucleotide
cuggcgcacggacuccugc

SEQ ID NO: 298 - RNA, 19 nt, Artificial Sequence
  Description of Artificial Sequence: Synthetic oligonucleotide
uggcgcacggacuccugca

SEQ ID NO: 299 - RNA, 19 nt, Artificial Sequence
  Description of Artificial Sequence: Synthetic oligonucleotide
ggcgcacggacuccugcag

SEQ ID NO: 300 - RNA, 19 nt, Artificial Sequence
  Description of Artificial Sequence: Synthetic oligonucleotide
gcgcacggacuccugcagc

SEQ ID NO: 301 - RNA, 19 nt, Artificial Sequence
  Description of Artificial Sequence: Synthetic oligonucleotide
cgcacggacuccugcagcu

SEQ ID NO: 302 - RNA, 19 nt, Artificial Sequence
  Description of Artificial Sequence: Synthetic oligonucleotide
gcacggacuccugcagcuc

SEQ ID NO: 303 - RNA, 19 nt, Artificial Sequence
  Description of Artificial Sequence: Synthetic oligonucleotide
cacggacuccugcagcucg

SEQ ID NO: 304 - RNA, 19 nt, Artificial Sequence
  Description of Artificial Sequence: Synthetic oligonucleotide
acggacuccugcagcucgg

SEQ ID NO: 305 - RNA, 19 nt, Artificial Sequence
  Description of Artificial Sequence: Synthetic oligonucleotide
cggacuccugcagcucggc

SEQ ID NO: 306 - RNA, 19 nt, Artificial Sequence
  Description of Artificial Sequence: Synthetic oligonucleotide
ggacuccugcagcucggcc

SEQ ID NO: 307 - RNA, 19 nt, Artificial Sequence
  Description of Artificial Sequence: Synthetic oligonucleotide
gacuccugcagcucggcca

SEQ ID NO: 308 - RNA, 19 nt, Artificial Sequence
  Description of Artificial Sequence: Synthetic oligonucleotide
acuccugcagcucggccag

SEQ ID NO: 309 - RNA, 19 nt, Artificial Sequence
  Description of Artificial Sequence: Synthetic oligonucleotide
cuccugcagcucggccagg

SEQ ID NO: 310 - RNA, 19 nt, Artificial Sequence
  Description of Artificial Sequence: Synthetic oligonucleotide
uccugcagcucggccaggg

SEQ ID NO: 311 - RNA, 19 nt, Artificial Sequence
  Description of Artificial Sequence: Synthetic oligonucleotide
ccugcagcucggccagggg

SEQ ID NO: 312 - RNA, 19 nt, Artificial Sequence
  Description of Artificial Sequence: Synthetic oligonucleotide
cugcagcucggccaggggc

SEQ ID NO: 313 - RNA, 19 nt, Artificial Sequence
  Description of Artificial Sequence: Synthetic oligonucleotide
ugcagcucggccaggggcu

SEQ ID NO: 314 - RNA, 19 nt, Artificial Sequence
  Description of Artificial Sequence: Synthetic oligonucleotide
gcagcucggccaggggcug

SEQ ID NO: 315 - RNA, 19 nt, Artificial Sequence
  Description of Artificial Sequence: Synthetic oligonucleotide
cagcucggccaggggcugc

SEQ ID NO: 316 - RNA, 19 nt, Artificial Sequence
  Description of Artificial Sequence: Synthetic oligonucleotide
agcucggccaggggcugcg

SEQ ID NO: 317 - RNA, 19 nt, Artificial Sequence
  Description of Artificial Sequence: Synthetic oligonucleotide
gcucggccaggggcugcgc

SEQ ID NO: 318 - RNA, 19 nt, Artificial Sequence
  Description of Artificial Sequence: Synthetic oligonucleotide
cucggccaggggcugcgcg

SEQ ID NO: 319 - RNA, 19 nt, Artificial Sequence
  Description of Artificial Sequence: Synthetic oligonucleotide
ucggccaggggcugcgcga

SEQ ID NO: 320 - RNA, 19 nt, Artificial Sequence
  Description of Artificial Sequence: Synthetic oligonucleotide
cggccaggggcugcgcgaa

SEQ ID NO: 321 - RNA, 19 nt, Artificial Sequence
  Description of Artificial Sequence: Synthetic oligonucleotide
ggccaggggcugcgcgaac

SEQ ID NO: 322 - RNA, 19 nt, Artificial Sequence
  Description of Artificial Sequence: Synthetic oligonucleotide
gccaggggcugcgcgaaca

SEQ ID NO: 323 - RNA, 19 nt, Artificial Sequence
  Description of Artificial Sequence: Synthetic oligonucleotide
ccaggggcugcgcgaacac

SEQ ID NO: 324 - RNA, 19 nt, Artificial Sequence
  Description of Artificial Sequence: Synthetic oligonucleotide
caggggcugcgcgaacacg

SEQ ID NO: 325 - RNA, 19 nt, Artificial Sequence
  Description of Artificial Sequence: Synthetic oligonucleotide
aggggcugcgcgaacacgc

SEQ ID NO: 326 - RNA, 19 nt, Artificial Sequence
  Description of Artificial Sequence: Synthetic oligonucleotide
ggggcugcgcgaacacgcg

SEQ ID NO: 327 - RNA, 19 nt, Artificial Sequence
  Description of Artificial Sequence: Synthetic oligonucleotide
gggcugcgcgaacacgcgg

SEQ ID NO: 328 - RNA, 19 nt, Artificial Sequence
  Description of Artificial Sequence: Synthetic oligonucleotide
ggcugcgcgaacacgcgga

SEQ ID NO: 329 - RNA, 19 nt, Artificial Sequence
  Description of Artificial Sequence: Synthetic oligonucleotide
gcugcgcgaacacgcggag

SEQ ID NO: 330 - RNA, 19 nt, Artificial Sequence
  Description of Artificial Sequence: Synthetic oligonucleotide
cugcgcgaacacgcggagc

SEQ ID NO: 331 - RNA, 19 nt, Artificial Sequence
  Description of Artificial Sequence: Synthetic oligonucleotide
ugcgcgaacacgcggagcg

SEQ ID NO: 332 - RNA, 19 nt, Artificial Sequence
  Description of Artificial Sequence: Synthetic oligonucleotide
gcgcgaacacgcggagcgc

SEQ ID NO: 333 - RNA, 19 nt, Artificial Sequence
  Description of Artificial Sequence: Synthetic oligonucleotide
cgcgaacacgcggagcgca

SEQ ID NO: 334 - RNA, 19 nt, Artificial Sequence
  Description of Artificial Sequence: Synthetic oligonucleotide
gcgaacacgcggagcgcac

SEQ ID NO: 335 - RNA, 19 nt, Artificial Sequence
  Description of Artificial Sequence: Synthetic oligonucleotide
cgaacacgcggagcgcacc

SEQ ID NO: 336 - RNA, 19 nt, Artificial Sequence
  Description of Artificial Sequence: Synthetic oligonucleotide
gaacacgcggagcgcaccc

SEQ ID NO: 337 - RNA, 19 nt, Artificial Sequence
  Description of Artificial Sequence: Synthetic oligonucleotide
aacacgcggagcgcacccg

SEQ ID NO: 338 - RNA, 19 nt, Artificial Sequence
  Description of Artificial Sequence: Synthetic oligonucleotide
acacgcggagcgcacccgc

SEQ ID NO: 339 - RNA, 19 nt, Artificial Sequence
  Description of Artificial Sequence: Synthetic oligonucleotide
cacgcggagcgcacccgca

SEQ ID NO: 340 - RNA, 19 nt, Artificial Sequence
  Description of Artificial Sequence: Synthetic oligonucleotide
acgcggagcgcacccgcag

SEQ ID NO: 341 - RNA, 19 nt, Artificial Sequence
  Description of Artificial Sequence: Synthetic oligonucleotide
cgcggagcgcacccgcagu

SEQ ID NO: 342 - RNA, 19 nt, Artificial Sequence
  Description of Artificial Sequence: Synthetic oligonucleotide
gcggagcgcacccgcaguc

SEQ ID NO: 343 - RNA, 19 nt, Artificial Sequence
  Description of Artificial Sequence: Synthetic oligonucleotide
cggagcgcacccgcaguca

SEQ ID NO: 344 - RNA, 19 nt, Artificial Sequence
  Description of Artificial Sequence: Synthetic oligonucleotide
ggagcgcacccgcagucag

SEQ ID NO: 345 - RNA, 19 nt, Artificial Sequence
  Description of Artificial Sequence: Synthetic oligonucleotide
gagcgcacccgcagucagc

SEQ ID NO: 346 - RNA, 19 nt, Artificial Sequence
  Description of Artificial Sequence: Synthetic oligonucleotide
agcgcacccgcagucagcu

SEQ ID NO: 347 - RNA, 19 nt, Artificial Sequence
  Description of Artificial Sequence: Synthetic oligonucleotide
gcgcacccgcagucagcug

SEQ ID NO: 348 - RNA, 19 nt, Artificial Sequence
  Description of Artificial Sequence: Synthetic oligonucleotide
cgcacccgcagucagcuga

SEQ ID NO: 349 - RNA, 19 nt, Artificial Sequence
  Description of Artificial Sequence: Synthetic oligonucleotide
gcacccgcagucagcugag

SEQ ID NO: 350 - RNA, 19 nt, Artificial Sequence
  Description of Artificial Sequence: Synthetic oligonucleotide
cacccgcagucagcugagc

SEQ ID NO: 351 - RNA, 19 nt, Artificial Sequence
  Description of Artificial Sequence: Synthetic oligonucleotide
acccgcagucagcugagcg

SEQ ID NO: 352 - RNA, 19 nt, Artificial Sequence
  Description of Artificial Sequence: Synthetic oligonucleotide
cccgcagucagcugagcgc

SEQ ID NO: 353 - RNA, 19 nt, Artificial Sequence
  Description of Artificial Sequence: Synthetic oligonucleotide
ccgcagucagcugagcgcg

SEQ ID NO: 354 - RNA, 19 nt, Artificial Sequence
  Description of Artificial Sequence: Synthetic oligonucleotide
cgcagucagcugagcgcgc

SEQ ID NO: 355 - RNA, 19 nt, Artificial Sequence
  Description of Artificial Sequence: Synthetic oligonucleotide
gcagucagcugagcgcgcu

SEQ ID NO: 356 - RNA, 19 nt, Artificial Sequence
  Description of Artificial Sequence: Synthetic oligonucleotide
cagucagcugagcgcgcug

SEQ ID NO: 357 - RNA, 19 nt, Artificial Sequence
  Description of Artificial Sequence: Synthetic oligonucleotide
agucagcugagcgcgcugg

SEQ ID NO: 358 - RNA, 19 nt, Artificial Sequence
  Description of Artificial Sequence: Synthetic oligonucleotide
gucagcugagcgcgcugga

SEQ ID NO: 359 - RNA, 19 nt, Artificial Sequence
  Description of Artificial Sequence: Synthetic oligonucleotide
ucagcugagcgcgcuggag

SEQ ID NO: 360 - RNA, 19 nt, Artificial Sequence
  Description of Artificial Sequence: Synthetic oligonucleotide
cagcugagcgcgcuggagc

SEQ ID NO: 361 - RNA, 19 nt, Artificial Sequence
  Description of Artificial Sequence: Synthetic oligonucleotide
agcugagcgcgcuggagcg

SEQ ID NO: 362 - RNA, 19 nt, Artificial Sequence
  Description of Artificial Sequence: Synthetic oligonucleotide
gcugagcgcgcuggagcgg

SEQ ID NO: 363 - RNA, 19 nt, Artificial Sequence
  Description of Artificial Sequence: Synthetic oligonucleotide
cugagcgcgcuggagcggc

SEQ ID NO: 364 - RNA, 19 nt, Artificial Sequence
  Description of Artificial Sequence: Synthetic oligonucleotide
ugagcgcgcuggagcggcg

SEQ ID NO: 365 - RNA, 19 nt, Artificial Sequence
  Description of Artificial Sequence: Synthetic oligonucleotide
gagcgcgcuggagcggcgc

SEQ ID NO: 366 - RNA, 19 nt, Artificial Sequence
  Description of Artificial Sequence: Synthetic oligonucleotide
agcgcgcuggagcggcgcc

SEQ ID NO: 367 - RNA, 19 nt, Artificial Sequence
  Description of Artificial Sequence: Synthetic oligonucleotide
gcgcgcuggagcggcgccu

SEQ ID NO: 368 - RNA, 19 nt, Artificial Sequence
  Description of Artificial Sequence: Synthetic oligonucleotide
cgcgcuggagcggcgccug

SEQ ID NO: 369 - RNA, 19 nt, Artificial Sequence
  Description of Artificial Sequence: Synthetic oligonucleotide
gcgcuggagcggcgccuga

SEQ ID NO: 370 - RNA, 19 nt, Artificial Sequence
  Description of Artificial Sequence: Synthetic oligonucleotide
cgcuggagcggcgccugag

SEQ ID NO: 371 - RNA, 19 nt, Artificial Sequence
  Description of Artificial Sequence: Synthetic oligonucleotide
gcuggagcggcgccugagc

SEQ ID NO: 372 - RNA, 19 nt, Artificial Sequence
  Description of Artificial Sequence: Synthetic oligonucleotide
cuggagcggcgccugagcg

SEQ ID NO: 373 - RNA, 19 nt, Artificial Sequence
  Description of Artificial Sequence: Synthetic oligonucleotide
uggagcggcgccugagcgc

SEQ ID NO: 374 - RNA, 19 nt, Artificial Sequence
  Description of Artificial Sequence: Synthetic oligonucleotide
ggagcggcgccugagcgcg

SEQ ID NO: 375 - RNA, 19 nt, Artificial Sequence
  Description of Artificial Sequence: Synthetic oligonucleotide
gagcggcgccugagcgcgu

SEQ ID NO: 376 - RNA, 19 nt, Artificial Sequence
  Description of Artificial Sequence: Synthetic oligonucleotide
agcggcgccugagcgcgug

SEQ ID NO: 377 - RNA, 19 nt, Artificial Sequence
  Description of Artificial Sequence: Synthetic oligonucleotide
gcggcgccugagcgcgugc

SEQ ID NO: 378 - RNA, 19 nt, Artificial Sequence
  Description of Artificial Sequence: Synthetic oligonucleotide
cggcgccugagcgcgugcg

SEQ ID NO: 379 - RNA, 19 nt, Artificial Sequence
  Description of Artificial Sequence: Synthetic oligonucleotide
ggcgccugagcgcgugcgg

SEQ ID NO: 380 - RNA, 19 nt, Artificial Sequence
  Description of Artificial Sequence: Synthetic oligonucleotide
gcgccugagcgcgugcggg

SEQ ID NO: 381 - RNA, 19 nt, Artificial Sequence
  Description of Artificial Sequence: Synthetic oligonucleotide
cgccugagcgcgugcgggu

SEQ ID NO: 382 - RNA, 19 nt, Artificial Sequence
  Description of Artificial Sequence: Synthetic oligonucleotide
gccugagcgcgugcggguc

SEQ ID NO: 383 - RNA, 19 nt, Artificial Sequence
  Description of Artificial Sequence: Synthetic oligonucleotide
ccugagcgcgugcgggucc

SEQ ID NO: 384 - RNA, 19 nt, Artificial Sequence
  Description of Artificial Sequence: Synthetic oligonucleotide
cugagcgcgugcggguccg

SEQ ID NO: 385 - RNA, 19 nt, Artificial Sequence
  Description of Artificial Sequence: Synthetic oligonucleotide
ugagcgcgugcggguccgc

SEQ ID NO: 386 - RNA, 19 nt, Artificial Sequence
  Description of Artificial Sequence: Synthetic oligonucleotide
gagcgcgugcggguccgcc

SEQ ID NO: 387 - RNA, 19 nt, Artificial Sequence
  Description of Artificial Sequence: Synthetic oligonucleotide
agcgcgugcggguccgccu

SEQ ID NO: 388 - RNA, 19 nt, Artificial Sequence
  Description of Artificial Sequence: Synthetic oligonucleotide
gcgcgugcggguccgccug

SEQ ID NO: 389 - RNA, 19 nt, Artificial Sequence
  Description of Artificial Sequence: Synthetic oligonucleotide
cgcgugcggguccgccugu

SEQ ID NO: 390 - RNA, 19 nt, Artificial Sequence
  Description of Artificial Sequence: Synthetic oligonucleotide
gcgugcggguccgccuguc

SEQ ID NO: 391 - RNA, 19 nt, Artificial Sequence
  Description of Artificial Sequence: Synthetic oligonucleotide
cgugcggguccgccuguca

SEQ ID NO: 392 - RNA, 19 nt, Artificial Sequence
  Description of Artificial Sequence: Synthetic oligonucleotide
gugcggguccgccugucag

SEQ ID NO: 393 - RNA, 19 nt, Artificial Sequence
  Description of Artificial Sequence: Synthetic oligonucleotide
ugcggguccgccugucagg

SEQ ID NO: 394 - RNA, 19 nt, Artificial Sequence
  Description of Artificial Sequence: Synthetic oligonucleotide
gcggguccgccugucaggg

SEQ ID NO: 395 - RNA, 19 nt, Artificial Sequence
  Description of Artificial Sequence: Synthetic oligonucleotide
cggguccgccugucaggga

SEQ ID NO: 396 - RNA, 19 nt, Artificial Sequence
  Description of Artificial Sequence: Synthetic oligonucleotide
ggguccgccugucagggaa

SEQ ID NO: 397 - RNA, 19 nt, Artificial Sequence
  Description of Artificial Sequence: Synthetic oligonucleotide
gguccgccugucagggaac

SEQ ID NO: 398 - RNA, 19 nt, Artificial Sequence
  Description of Artificial Sequence: Synthetic oligonucleotide
guccgccugucagggaacc

SEQ ID NO: 399 - RNA, 19 nt, Artificial Sequence
  Description of Artificial Sequence: Synthetic oligonucleotide
uccgccugucagggaaccg

SEQ ID NO: 400 - RNA, 19 nt, Artificial Sequence
  Description of Artificial Sequence: Synthetic oligonucleotide
ccgccugucagggaaccga

SEQ ID NO: 401 - RNA, 19 nt, Artificial Sequence
  Description of Artificial Sequence: Synthetic oligonucleotide
cgccugucagggaaccgag

SEQ ID NO: 402 - RNA, 19 nt, Artificial Sequence
  Description of Artificial Sequence: Synthetic oligonucleotide
gccugucagggaaccgagg

SEQ ID NO: 403 - RNA, 19 nt, Artificial Sequence
  Description of Artificial Sequence: Synthetic oligonucleotide
ccugucagggaaccgaggg

SEQ ID NO: 404 - RNA, 19 nt, Artificial Sequence
  Description of Artificial Sequence: Synthetic oligonucleotide
cugucagggaaccgagggg

SEQ ID NO: 405 - RNA, 19 nt, Artificial Sequence
  Description of Artificial Sequence: Synthetic oligonucleotide
ugucagggaaccgaggggu

SEQ ID NO: 406 - RNA, 19 nt, Artificial Sequence
  Description of Artificial Sequence: Synthetic oligonucleotide
gucagggaaccgagggguc

SEQ ID NO: 407 - RNA, 19 nt, Artificial Sequence
  Description of Artificial Sequence: Synthetic oligonucleotide
ucagggaaccgaggggucc

SEQ ID NO: 408 - RNA, 19 nt, Artificial Sequence
  Description of Artificial Sequence: Synthetic oligonucleotide
cagggaaccgaggggucca

SEQ ID NO: 409 - RNA, 19 nt, Artificial Sequence
  Description of Artificial Sequence: Synthetic oligonucleotide
agggaaccgagggguccac

SEQ ID NO: 410 - RNA, 19 nt, Artificial Sequence
  Description of Artificial Sequence: Synthetic oligonucleotide
gggaaccgagggguccacc

SEQ ID NO: 411 - RNA, 19 nt, Artificial Sequence
  Description of Artificial Sequence: Synthetic oligonucleotide
ggaaccgagggguccaccg

SEQ ID NO: 412 - RNA, 19 nt, Artificial Sequence
  Description of Artificial Sequence: Synthetic oligonucleotide
gaaccgagggguccaccga

SEQ ID NO: 413 - RNA, 19 nt, Artificial Sequence
  Description of Artificial Sequence: Synthetic oligonucleotide
aaccgagggguccaccgac

SEQ ID NO: 414 - RNA, 19 nt, Artificial Sequence
  Description of Artificial Sequence: Synthetic oligonucleotide
accgagggguccaccgacc

SEQ ID NO: 415 - RNA, 19 nt, Artificial Sequence
  Description of Artificial Sequence: Synthetic oligonucleotide
ccgagggguccaccgaccu

SEQ ID NO: 416 - RNA, 19 nt, Artificial Sequence
  Description of Artificial Sequence: Synthetic oligonucleotide
cgagggguccaccgaccuc

SEQ ID NO: 417 - RNA, 19 nt, Artificial Sequence
  Description of Artificial Sequence: Synthetic oligonucleotide
gagggguccaccgaccucc

SEQ ID NO: 418 - RNA, 19 nt, Artificial Sequence
  Description of Artificial Sequence: Synthetic oligonucleotide
agggguccaccgaccuccc

SEQ ID NO: 419 - RNA, 19 nt, Artificial Sequence
  Description of Artificial Sequence: Synthetic oligonucleotide
gggguccaccgaccucccg

SEQ ID NO: 420 - RNA, 19 nt, Artificial Sequence
  Description of Artificial Sequence: Synthetic oligonucleotide
ggguccaccgaccucccgu

SEQ ID NO: 421 - RNA, 19 nt, Artificial Sequence
  Description of Artificial Sequence: Synthetic oligonucleotide
gguccaccgaccucccguu

SEQ ID NO: 422 - RNA, 19 nt, Artificial Sequence
  Description of Artificial Sequence: Synthetic oligonucleotide
guccaccgaccucccguua

SEQ ID NO: 423 - RNA, 19 nt, Artificial Sequence
  Description of Artificial Sequence: Synthetic oligonucleotide
uccaccgaccucccguuag

SEQ ID NO: 424 - RNA, 19 nt, Artificial Sequence
  Description of Artificial Sequence: Synthetic oligonucleotide
ccaccgaccucccguuagc

SEQ ID NO: 425 - RNA, 19 nt, Artificial Sequence
  Description of Artificial Sequence: Synthetic oligonucleotide
caccgaccucccguuagcc

SEQ ID NO: 426 - RNA, 19 nt, Artificial Sequence
  Description of Artificial Sequence: Synthetic oligonucleotide
accgaccucccguuagccc

SEQ ID NO: 427 - RNA, 19 nt, Artificial Sequence
  Description of Artificial Sequence: Synthetic oligonucleotide
ccgaccucccguuagcccc

SEQ ID NO: 428 - RNA, 19 nt, Artificial Sequence
  Description of Artificial Sequence: Synthetic oligonucleotide
cgaccucccguuagccccu

SEQ ID NO: 429 - RNA, 19 nt, Artificial Sequence
  Description of Artificial Sequence: Synthetic oligonucleotide
gaccucccguuagccccug

SEQ ID NO: 430 - RNA, 19 nt, Artificial Sequence
  Description of Artificial Sequence: Synthetic oligonucleotide
accucccguuagccccuga

SEQ ID NO: 431 - RNA, 19 nt, Artificial Sequence
  Description of Artificial Sequence: Synthetic oligonucleotide
ccucccguuagccccugag

SEQ ID NO: 432 - RNA, 19 nt, Artificial Sequence
  Description of Artificial Sequence: Synthetic oligonucleotide
cucccguuagccccugaga

SEQ ID NO: 433 - RNA, 19 nt, Artificial Sequence
  Description of Artificial Sequence: Synthetic oligonucleotide
ucccguuagccccugagag

SEQ ID NO: 434 - RNA, 19 nt, Artificial Sequence
  Description of Artificial Sequence: Synthetic oligonucleotide
cccguuagccccugagagc

SEQ ID NO: 435 - RNA, 19 nt, Artificial Sequence
  Description of Artificial Sequence: Synthetic oligonucleotide
ccguuagccccugagagcc

SEQ ID NO: 436 - RNA, 19 nt, Artificial Sequence
  Description of Artificial Sequence: Synthetic oligonucleotide
cguuagccccugagagccg

SEQ ID NO: 437 - RNA, 19 nt, Artificial Sequence
  Description of Artificial Sequence: Synthetic oligonucleotide
guuagccccugagagccgg

SEQ ID NO: 438 - RNA, 19 nt, Artificial Sequence
  Description of Artificial Sequence: Synthetic oligonucleotide
uuagccccugagagccggg

SEQ ID NO: 439 - RNA, 19 nt, Artificial Sequence
  Description of Artificial Sequence: Synthetic oligonucleotide
uagccccugagagccgggu

SEQ ID NO: 440 - RNA, 19 nt, Artificial Sequence
  Description of Artificial Sequence: Synthetic oligonucleotide
agccccugagagccgggug

SEQ ID NO: 441 - RNA, 19 nt, Artificial Sequence
  Description of Artificial Sequence: Synthetic oligonucleotide
gccccugagagccgggugg

SEQ ID NO: 442 - RNA, 19 nt, Artificial Sequence
  Description of Artificial Sequence: Synthetic oligonucleotide
ccccugagagccgggugga

SEQ ID NO: 443 - RNA, 19 nt, Artificial Sequence
  Description of Artificial Sequence: Synthetic oligonucleotide
cccugagagccggguggac

SEQ ID NO: 444 - RNA, 19 nt, Artificial Sequence
  Description of Artificial Sequence: Synthetic oligonucleotide
ccugagagccggguggacc

SEQ ID NO: 445 - RNA, 19 nt, Artificial Sequence
  Description of Artificial Sequence: Synthetic oligonucleotide
cugagagccggguggaccc

SEQ ID NO: 446 - RNA, 19 nt, Artificial Sequence
  Description of Artificial Sequence: Synthetic oligonucleotide
ugagagccggguggacccu

SEQ ID NO: 447 - RNA, 19 nt, Artificial Sequence
  Description of Artificial Sequence: Synthetic oligonucleotide
gagagccggguggacccug

SEQ ID NO: 448 - RNA, 19 nt, Artificial Sequence
  Description of Artificial Sequence: Synthetic oligonucleotide
agagccggguggacccuga

SEQ ID NO: 449 - RNA, 19 nt, Artificial Sequence
  Description of Artificial Sequence: Synthetic oligonucleotide
gagccggguggacccugag

SEQ ID NO: 450 - RNA, 19 nt, Artificial Sequence
  Description of Artificial Sequence: Synthetic oligonucleotide
agccggguggacccugagg

SEQ ID NO: 451 - RNA, 19 nt, Artificial Sequence
  Description of Artificial Sequence: Synthetic oligonucleotide
gccggguggacccugaggu

SEQ ID NO: 452 - RNA, 19 nt, Artificial Sequence
  Description of Artificial Sequence: Synthetic oligonucleotide
ccggguggacccugagguc

SEQ ID NO: 453 - RNA, 19 nt, Artificial Sequence
  Description of Artificial Sequence: Synthetic oligonucleotide
cggguggacccugaggucc

SEQ ID NO: 454 - RNA, 19 nt, Artificial Sequence
  Description of Artificial Sequence: Synthetic oligonucleotide
ggguggacccugagguccu

SEQ ID NO: 455 - RNA, 19 nt, Artificial Sequence
  Description of Artificial Sequence: Synthetic oligonucleotide
gguggacccugagguccuu

SEQ ID NO: 456 - RNA, 19 nt, Artificial Sequence
  Description of Artificial Sequence: Synthetic oligonucleotide
guggacccugagguccuuc

SEQ ID NO: 457 - RNA, 19 nt, Artificial Sequence
  Description of Artificial Sequence: Synthetic oligonucleotide
uggacccugagguccuuca

SEQ ID NO: 458 - RNA, 19 nt, Artificial Sequence
  Description of Artificial Sequence: Synthetic oligonucleotide
ggacccugagguccuucac

SEQ ID NO: 459 - RNA, 19 nt, Artificial Sequence
  Description of Artificial Sequence: Synthetic oligonucleotide
gacccugagguccuucaca

SEQ ID NO: 460 - RNA, 19 nt, Artificial Sequence
  Description of Artificial Sequence: Synthetic oligonucleotide
acccugagguccuucacag

SEQ ID NO: 461 - RNA, 19 nt, Artificial Sequence
  Description of Artificial Sequence: Synthetic oligonucleotide
cccugagguccuucacagc

SEQ ID NO: 462 - RNA, 19 nt, Artificial Sequence
  Description of Artificial Sequence: Synthetic oligonucleotide
ccugagguccuucacagcc

SEQ ID NO: 463 - RNA, 19 nt, Artificial Sequence
  Description of Artificial Sequence: Synthetic oligonucleotide
cugagguccuucacagccu

SEQ ID NO: 464 - RNA, 19 nt, Artificial Sequence
  Description of Artificial Sequence: Synthetic oligonucleotide
ugagguccuucacagccug

SEQ ID NO: 465 - RNA, 19 nt, Artificial Sequence
  Description of Artificial Sequence: Synthetic oligonucleotide
gagguccuucacagccugc

SEQ ID NO: 466 - RNA, 19 nt, Artificial Sequence
  Description of Artificial Sequence: Synthetic oligonucleotide
agguccuucacagccugca

SEQ ID NO: 467 - RNA, 19 nt, Artificial Sequence
  Description of Artificial Sequence: Synthetic oligonucleotide
gguccuucacagccugcag

SEQ ID NO: 468 - RNA, 19 nt, Artificial Sequence
  Description of Artificial Sequence: Synthetic oligonucleotide
guccuucacagccugcaga

SEQ ID NO: 469 - RNA, 19 nt, Artificial Sequence
  Description of Artificial Sequence: Synthetic oligonucleotide
uccuucacagccugcagac

SEQ ID NO: 470 - RNA, 19 nt, Artificial Sequence
  Description of Artificial Sequence: Synthetic oligonucleotide
ccuucacagccugcagaca

SEQ ID NO: 471 - RNA, 19 nt, Artificial Sequence
  Description of Artificial Sequence: Synthetic oligonucleotide
cuucacagccugcagacac

SEQ ID NO: 472 - RNA, 19 nt, Artificial Sequence
  Description of Artificial Sequence: Synthetic oligonucleotide
uucacagccugcagacaca

SEQ ID NO: 473 - RNA, 19 nt, Artificial Sequence
  Description of Artificial Sequence: Synthetic oligonucleotide
ucacagccugcagacacaa

SEQ ID NO: 474 - RNA, 19 nt, Artificial Sequence
  Description of Artificial Sequence: Synthetic oligonucleotide
cacagccugcagacacaac

SEQ ID NO: 475 - RNA, 19 nt, Artificial Sequence
  Description of Artificial Sequence: Synthetic oligonucleotide
acagccugcagacacaacu

SEQ ID NO: 476 - RNA, 19 nt, Artificial Sequence
  Description of Artificial Sequence: Synthetic oligonucleotide
cagccugcagacacaacuc

SEQ ID NO: 477 - RNA, 19 nt, Artificial Sequence
  Description of Artificial Sequence: Synthetic oligonucleotide
agccugcagacacaacuca

SEQ ID NO: 478 - RNA, 19 nt, Artificial Sequence
  Description of Artificial Sequence: Synthetic oligonucleotide
gccugcagacacaacucaa

SEQ ID NO: 479 - RNA, 19 nt, Artificial Sequence
  Description of Artificial Sequence: Synthetic oligonucleotide
ccugcagacacaacucaag

SEQ ID NO: 480 - RNA, 19 nt, Artificial Sequence
  Description of Artificial Sequence: Synthetic oligonucleotide
cugcagacacaacucaagg

SEQ ID NO: 481 - RNA, 19 nt, Artificial Sequence
  Description of Artificial Sequence: Synthetic oligonucleotide
ugcagacacaacucaaggc

SEQ ID NO: 482 - RNA, 19 nt, Artificial Sequence
  Description of Artificial Sequence: Synthetic oligonucleotide
gcagacacaacucaaggcu

SEQ ID NO: 483 - RNA, 19 nt, Artificial Sequence
  Description of Artificial Sequence: Synthetic oligonucleotide
cagacacaacucaaggcuc

SEQ ID NO: 484 - RNA, 19 nt, Artificial Sequence
  Description of Artificial Sequence: Synthetic oligonucleotide
agacacaacucaaggcuca

SEQ ID NO: 485 - RNA, 19 nt, Artificial Sequence
  Description of Artificial Sequence: Synthetic oligonucleotide
gacacaacucaaggcucag

SEQ ID NO: 486 - RNA, 19 nt, Artificial Sequence
  Description of Artificial Sequence: Synthetic oligonucleotide
acacaacucaaggcucaga

SEQ ID NO: 487 - RNA, 19 nt, Artificial Sequence
  Description of Artificial Sequence: Synthetic oligonucleotide
cacaacucaaggcucagaa

SEQ ID NO: 488 - RNA, 19 nt, Artificial Sequence
  Description of Artificial Sequence: Synthetic oligonucleotide
acaacucaaggcucagaac

SEQ ID NO: 489 - RNA, 19 nt, Artificial Sequence
  Description of Artificial Sequence: Synthetic oligonucleotide
caacucaaggcucagaaca

SEQ ID NO: 490 - RNA, 19 nt, Artificial Sequence
  Description of Artificial Sequence: Synthetic oligonucleotide
aacucaaggcucagaacag

SEQ ID NO: 491 - RNA, 19 nt, Artificial Sequence
  Description of Artificial Sequence: Synthetic oligonucleotide
acucaaggcucagaacagc

SEQ ID NO: 492 - RNA, 19 nt, Artificial Sequence
  Description of Artificial Sequence: Synthetic oligonucleotide
cucaaggcucagaacagca

SEQ ID NO: 493 - RNA, 19 nt, Artificial Sequence
  Description of Artificial Sequence: Synthetic oligonucleotide
ucaaggcucagaacagcag

SEQ ID NO: 494 - RNA, 19 nt, Artificial Sequence
  Description of Artificial Sequence: Synthetic oligonucleotide
caaggcucagaacagcagg

SEQ ID NO: 495 - RNA, 19 nt, Artificial Sequence
  Description of Artificial Sequence: Synthetic oligonucleotide
aaggcucagaacagcagga

SEQ ID NO: 496 - RNA, 19 nt, Artificial Sequence
  Description of Artificial Sequence: Synthetic oligonucleotide
aggcucagaacagcaggau

SEQ ID NO: 497 - RNA, 19 nt, Artificial Sequence
  Description of Artificial Sequence: Synthetic oligonucleotide
ggcucagaacagcaggauc

SEQ ID NO: 498 - RNA, 19 nt, Artificial Sequence
  Description of Artificial Sequence: Synthetic oligonucleotide
gcucagaacagcaggaucc

SEQ ID NO: 499 - RNA, 19 nt, Artificial Sequence
  Description of Artificial Sequence: Synthetic oligonucleotide
cucagaacagcaggaucca

SEQ ID NO: 500 - RNA, 19 nt, Artificial Sequence
  Description of Artificial Sequence: Synthetic oligonucleotide
ucagaacagcaggauccag

SEQ ID NO: 501 - RNA, 19 nt, Artificial Sequence
  Description of Artificial Sequence: Synthetic oligonucleotide
cagaacagcaggauccagc

SEQ ID NO: 502 - RNA, 19 nt, Artificial Sequence
  Description of Artificial Sequence: Synthetic oligonucleotide
agaacagcaggauccagca

SEQ ID NO: 503 - RNA, 19 nt, Artificial Sequence
  Description of Artificial Sequence: Synthetic oligonucleotide
gaacagcaggauccagcaa

SEQ ID NO: 504 - RNA, 19 nt, Artificial Sequence
  Description of Artificial Sequence: Synthetic oligonucleotide
aacagcaggauccagcaac

SEQ ID NO: 505 - RNA, 19 nt, Artificial Sequence
  Description of Artificial Sequence: Synthetic oligonucleotide
acagcaggauccagcaacu

SEQ ID NO: 506 - RNA, 19 nt, Artificial Sequence
  Description of Artificial Sequence: Synthetic oligonucleotide
cagcaggauccagcaacuc

SEQ ID NO: 507 - RNA, 19 nt, Artificial Sequence
  Description of Artificial Sequence: Synthetic oligonucleotide
agcaggauccagcaacucu

SEQ ID NO: 508 - RNA, 19 nt, Artificial Sequence
  Description of Artificial Sequence: Synthetic oligonucleotide
gcaggauccagcaacucuu

SEQ ID NO: 509 - RNA, 19 nt, Artificial Sequence
  Description of Artificial Sequence: Synthetic oligonucleotide
caggauccagcaacucuuc

SEQ ID NO: 510 - RNA, 19 nt, Artificial Sequence
  Description of Artificial Sequence: Synthetic oligonucleotide
aggauccagcaacucuucc

SEQ ID NO: 511 - RNA, 19 nt, Artificial Sequence
  Description of Artificial Sequence: Synthetic oligonucleotide
ggauccagcaacucuucca

SEQ ID NO: 512 - RNA, 19 nt, Artificial Sequence
  Description of Artificial Sequence: Synthetic oligonucleotide
gauccagcaacucuuccac

SEQ ID NO: 513 - RNA, 19 nt, Artificial Sequence
  Description of Artificial Sequence: Synthetic oligonucleotide
auccagcaacucuuccaca

SEQ ID NO: 514 - RNA, 19 nt, Artificial Sequence
  Description of Artificial Sequence: Synthetic oligonucleotide
uccagcaacucuuccacaa

SEQ ID NO: 515 - RNA, 19 nt, Artificial Sequence
  Description of Artificial Sequence: Synthetic oligonucleotide
ccagcaacucuuccacaag

SEQ ID NO: 516 - RNA, 19 nt, Artificial Sequence
  Description of Artificial Sequence: Synthetic oligonucleotide
cagcaacucuuccacaagg

SEQ ID NO: 517 - RNA, 19 nt, Artificial Sequence
  Description of Artificial Sequence: Synthetic oligonucleotide
agcaacucuuccacaaggu

SEQ ID NO: 518 - RNA, 19 nt, Artificial Sequence
  Description of Artificial Sequence: Synthetic oligonucleotide
gcaacucuuccacaaggug

SEQ ID NO: 519 - RNA, 19 nt, Artificial Sequence
  Description of Artificial Sequence: Synthetic oligonucleotide
caacucuuccacaaggugg

SEQ ID NO: 520 - RNA, 19 nt, Artificial Sequence
  Description of Artificial Sequence: Synthetic oligonucleotide
aacucuuccacaagguggc

SEQ ID NO: 521 - RNA, 19 nt, Artificial Sequence
  Description of Artificial Sequence: Synthetic oligonucleotide
acucuuccacaagguggcc

SEQ ID NO: 522 - RNA, 19 nt, Artificial Sequence
  Description of Artificial Sequence: Synthetic oligonucleotide
cucuuccacaagguggccc

SEQ ID NO: 523 - RNA, 19 nt, Artificial Sequence
  Description of Artificial Sequence: Synthetic oligonucleotide
ucuuccacaagguggccca

SEQ ID NO: 524 - RNA, 19 nt, Artificial Sequence
  Description of Artificial Sequence: Synthetic oligonucleotide
cuuccacaagguggcccag

SEQ ID NO: 525 - RNA, 19 nt, Artificial Sequence
  Description of Artificial Sequence: Synthetic oligonucleotide
uuccacaagguggcccagc

SEQ ID NO: 526 - RNA, 19 nt, Artificial Sequence
  Description of Artificial Sequence: Synthetic oligonucleotide
uccacaagguggcccagca

SEQ ID NO: 527 - RNA, 19 nt, Artificial Sequence
  Description of Artificial Sequence: Synthetic oligonucleotide
ccacaagguggcccagcag

SEQ ID NO: 528 - RNA, 19 nt, Artificial Sequence
  Description of Artificial Sequence: Synthetic oligonucleotide
cacaagguggcccagcagc

SEQ ID NO: 529 - RNA, 19 nt, Artificial Sequence
  Description of Artificial Sequence: Synthetic oligonucleotide
acaagguggcccagcagca

SEQ ID NO: 530 - RNA, 19 nt, Artificial Sequence
  Description of Artificial Sequence: Synthetic oligonucleotide
caagguggcccagcagcag

SEQ ID NO: 531 - RNA, 19 nt, Artificial Sequence
  Description of Artificial Sequence: Synthetic oligonucleotide
aagguggcccagcagcagc

SEQ ID NO: 532 - RNA, 19 nt, Artificial Sequence
  Description of Artificial Sequence: Synthetic oligonucleotide
agguggcccagcagcagcg

SEQ ID NO: 533 - RNA, 19 nt, Artificial Sequence
  Description of Artificial Sequence: Synthetic oligonucleotide
gguggcccagcagcagcgg

SEQ ID NO: 534 - RNA, 19 nt, Artificial Sequence
  Description of Artificial Sequence: Synthetic oligonucleotide
guggcccagcagcagcggc

SEQ ID NO: 535 - RNA, 19 nt, Artificial Sequence
  Description of Artificial Sequence: Synthetic oligonucleotide
uggcccagcagcagcggca

SEQ ID NO: 536 - RNA, 19 nt, Artificial Sequence
  Description of Artificial Sequence: Synthetic oligonucleotide
ggcccagcagcagcggcac

SEQ ID NO: 537 - RNA, 19 nt, Artificial Sequence
  Description of Artificial Sequence: Synthetic oligonucleotide
gcccagcagcagcggcacc

SEQ ID NO: 538 - RNA, 19 nt, Artificial Sequence
  Description of Artificial Sequence: Synthetic oligonucleotide
cccagcagcagcggcaccu

SEQ ID NO: 539 - RNA, 19 nt, Artificial Sequence
  Description of Artificial Sequence: Synthetic oligonucleotide
ccagcagcagcggcaccug

SEQ ID NO: 540 - RNA, 19 nt, Artificial Sequence
  Description of Artificial Sequence: Synthetic oligonucleotide
cagcagcagcggcaccugg

SEQ ID NO: 541 - RNA, 19 nt, Artificial Sequence
  Description of Artificial Sequence: Synthetic oligonucleotide
agcagcagcggcaccugga

SEQ ID NO: 542 - RNA, 19 nt, Artificial Sequence
  Description of Artificial Sequence: Synthetic oligonucleotide
gcagcagcggcaccuggag

SEQ ID NO: 543 - RNA, 19 nt, Artificial Sequence
  Description of Artificial Sequence: Synthetic oligonucleotide
cagcagcggcaccuggaga

SEQ ID NO: 544 - RNA, 19 nt, Artificial Sequence
  Description of Artificial Sequence: Synthetic oligonucleotide
agcagcggcaccuggagaa

SEQ ID NO: 545 - RNA, 19 nt, Artificial Sequence
  Description of Artificial Sequence: Synthetic oligonucleotide
gcagcggcaccuggagaag

SEQ ID NO: 546 - RNA, 19 nt, Artificial Sequence
  Description of Artificial Sequence: Synthetic oligonucleotide
cagcggcaccuggagaagc

SEQ ID NO: 547 - RNA, 19 nt, Artificial Sequence
  Description of Artificial Sequence: Synthetic oligonucleotide
agcggcaccuggagaagca

SEQ ID NO: 548 - RNA, 19 nt, Artificial Sequence
  Description of Artificial Sequence: Synthetic oligonucleotide
gcggcaccuggagaagcag

SEQ ID NO: 549 - RNA, 19 nt, Artificial Sequence
  Description of Artificial Sequence: Synthetic oligonucleotide
cggcaccuggagaagcagc

SEQ ID NO: 550 - RNA, 19 nt, Artificial Sequence
  Description of Artificial Sequence: Synthetic oligonucleotide
ggcaccuggagaagcagca

SEQ ID NO: 551 - RNA, 19 nt, Artificial Sequence
  Description of Artificial Sequence: Synthetic oligonucleotide
gcaccuggagaagcagcac

SEQ ID NO: 552 - RNA, 19 nt, Artificial Sequence
  Description of Artificial Sequence: Synthetic oligonucleotide
caccuggagaagcagcacc

SEQ ID NO: 553 - RNA, 19 nt, Artificial Sequence
  Description of Artificial Sequence: Synthetic oligonucleotide
accuggagaagcagcaccu

SEQ ID NO: 554 - RNA, 19 nt, Artificial Sequence
  Description of Artificial Sequence: Synthetic oligonucleotide
ccuggagaagcagcaccug

SEQ ID NO: 555 - RNA, 19 nt, Artificial Sequence
  Description of Artificial Sequence: Synthetic oligonucleotide
cuggagaagcagcaccugc

SEQ ID NO: 556 - RNA, 19 nt, Artificial Sequence
  Description of Artificial Sequence: Synthetic oligonucleotide
uggagaagcagcaccugcg

SEQ ID NO: 557 - RNA, 19 nt, Artificial Sequence
  Description of Artificial Sequence: Synthetic oligonucleotide
ggagaagcagcaccugcga

SEQ ID NO: 558 - RNA, 19 nt, Artificial Sequence
  Description of Artificial Sequence: Synthetic oligonucleotide
gagaagcagcaccugcgaa

SEQ ID NO: 559 - RNA, 19 nt, Artificial Sequence
  Description of Artificial Sequence: Synthetic oligonucleotide
agaagcagcaccugcgaau

SEQ ID NO: 560 - RNA, 19 nt, Artificial Sequence
  Description of Artificial Sequence: Synthetic oligonucleotide
gaagcagcaccugcgaauu

SEQ ID NO: 561 - RNA, 19 nt, Artificial Sequence
  Description of Artificial Sequence: Synthetic oligonucleotide
aagcagcaccugcgaauuc

SEQ ID NO: 562 - RNA, 19 nt, Artificial Sequence
  Description of Artificial Sequence: Synthetic oligonucleotide
agcagcaccugcgaauuca

SEQ ID NO: 563 - RNA, 19 nt, Artificial Sequence
  Description of Artificial Sequence: Synthetic oligonucleotide
gcagcaccugcgaauucag

SEQ ID NO: 564 - RNA, 19 nt, Artificial Sequence
  Description of Artificial Sequence: Synthetic oligonucleotide
cagcaccugcgaauucagc

SEQ ID NO: 565 - RNA, 19 nt, Artificial Sequence
  Description of Artificial Sequence: Synthetic oligonucleotide
agcaccugcgaauucagca

SEQ ID NO: 566 - RNA, 19 nt, Artificial Sequence
  Description of Artificial Sequence: Synthetic oligonucleotide
gcaccugcgaauucagcau

SEQ ID NO: 567 - RNA, 19 nt, Artificial Sequence
  Description of Artificial Sequence: Synthetic oligonucleotide
caccugcgaauucagcauc

SEQ ID NO: 568 - RNA, 19 nt, Artificial Sequence
  Description of Artificial Sequence: Synthetic oligonucleotide
accugcgaauucagcaucu

SEQ ID NO: 569 - RNA, 19 nt, Artificial Sequence
  Description of Artificial Sequence: Synthetic oligonucleotide
ccugcgaauucagcaucug

SEQ ID NO: 570 - RNA, 19 nt, Artificial Sequence
  Description of Artificial Sequence: Synthetic oligonucleotide
cugcgaauucagcaucugc

SEQ ID NO: 571 - RNA, 19 nt, Artificial Sequence
  Description of Artificial Sequence: Synthetic oligonucleotide
ugcgaauucagcaucugca

SEQ ID NO: 572 - RNA, 19 nt, Artificial Sequence
  Description of Artificial Sequence: Synthetic oligonucleotide
gcgaauucagcaucugcaa

SEQ ID NO: 573 - RNA, 19 nt, Artificial Sequence
  Description of Artificial Sequence: Synthetic oligonucleotide
cgaauucagcaucugcaaa

SEQ ID NO: 574 - RNA, 19 nt, Artificial Sequence
  Description of Artificial Sequence: Synthetic oligonucleotide
gaauucagcaucugcaaag

SEQ ID NO: 575 - RNA, 19 nt, Artificial Sequence
  Description of Artificial Sequence: Synthetic oligonucleotide
aauucagcaucugcaaagc

SEQ ID NO: 576 - RNA, 19 nt, Artificial Sequence
  Description of Artificial Sequence: Synthetic oligonucleotide
auucagcaucugcaaagcc

SEQ ID NO: 577 - RNA, 19 nt, Artificial Sequence
  Description of Artificial Sequence: Synthetic oligonucleotide
uucagcaucugcaaagcca

SEQ ID NO: 578 - RNA, 19 nt, Artificial Sequence
  Description of Artificial Sequence: Synthetic oligonucleotide
ucagcaucugcaaagccag

SEQ ID NO: 579 - RNA, 19 nt, Artificial Sequence
  Description of Artificial Sequence: Synthetic oligonucleotide
cagcaucugcaaagccagu

SEQ ID NO: 580 - RNA, 19 nt, Artificial Sequence
  Description of Artificial Sequence: Synthetic oligonucleotide
agcaucugcaaagccaguu

SEQ ID NO: 581 - RNA, 19 nt, Artificial Sequence
  Description of Artificial Sequence: Synthetic oligonucleotide
gcaucugcaaagccaguuu

SEQ ID NO: 582 - RNA, 19 nt, Artificial Sequence
  Description of Artificial Sequence: Synthetic oligonucleotide
caucugcaaagccaguuug

SEQ ID NO: 583 - RNA, 19 nt, Artificial Sequence
  Description of Artificial Sequence: Synthetic oligonucleotide
aucugcaaagccaguuugg

SEQ ID NO: 584 - RNA, 19 nt, Artificial Sequence
  Description of Artificial Sequence: Synthetic oligonucleotide
ucugcaaagccaguuuggc

SEQ ID NO: 585 - RNA, 19 nt, Artificial Sequence
  Description of Artificial Sequence: Synthetic oligonucleotide
cugcaaagccaguuuggcc

SEQ ID NO: 586 - RNA, 19 nt, Artificial Sequence
  Description of Artificial Sequence: Synthetic oligonucleotide
ugcaaagccaguuuggccu

SEQ ID NO: 587 - RNA, 19 nt, Artificial Sequence
  Description of Artificial Sequence: Synthetic oligonucleotide
gcaaagccaguuuggccuc

SEQ ID NO: 588 - RNA, 19 nt, Artificial Sequence
  Description of Artificial Sequence: Synthetic oligonucleotide
caaagccaguuuggccucc

SEQ ID NO: 589 - RNA, 19 nt, Artificial Sequence
  Description of Artificial Sequence: Synthetic oligonucleotide
aaagccaguuuggccuccu

SEQ ID NO: 590 - RNA, 19 nt, Artificial Sequence
  Description of Artificial Sequence: Synthetic oligonucleotide
aagccaguuuggccuccug

SEQ ID NO: 591 - RNA, 19 nt, Artificial Sequence
  Description of Artificial Sequence: Synthetic oligonucleotide
agccaguuuggccuccugg

SEQ ID NO: 592 - RNA, 19 nt, Artificial Sequence
  Description of Artificial Sequence: Synthetic oligonucleotide
gccaguuuggccuccugga

SEQ ID NO: 593 - RNA, 19 nt, Artificial Sequence
  Description of Artificial Sequence: Synthetic oligonucleotide
ccaguuuggccuccuggac

SEQ ID NO: 594 - RNA, 19 nt, Artificial Sequence
  Description of Artificial Sequence: Synthetic oligonucleotide
caguuuggccuccuggacc

SEQ ID NO: 595 - RNA, 19 nt, Artificial Sequence
  Description of Artificial Sequence: Synthetic oligonucleotide
aguuuggccuccuggacca

SEQ ID NO: 596 - RNA, 19 nt, Artificial Sequence
  Description of Artificial Sequence: Synthetic oligonucleotide
guuuggccuccuggaccac

SEQ ID NO: 597 - RNA, 19 nt, Artificial Sequence
  Description of Artificial Sequence: Synthetic oligonucleotide
uuuggccuccuggaccaca

SEQ ID NO: 598 - RNA, 19 nt, Artificial Sequence
  Description of Artificial Sequence: Synthetic oligonucleotide
uuggccuccuggaccacaa

SEQ ID NO: 599 - RNA, 19 nt, Artificial Sequence
  Description of Artificial Sequence: Synthetic oligonucleotide
uggccuccuggaccacaag

SEQ ID NO: 600 - RNA, 19 nt, Artificial Sequence
  Description of Artificial Sequence: Synthetic oligonucleotide
ggccuccuggaccacaagc

SEQ ID NO: 601 - RNA, 19 nt, Artificial Sequence
  Description of Artificial Sequence: Synthetic oligonucleotide
gccuccuggaccacaagca

SEQ ID NO: 602 - RNA, 19 nt, Artificial Sequence
  Description of Artificial Sequence: Synthetic oligonucleotide
ccuccuggaccacaagcac

SEQ ID NO: 603 - RNA, 19 nt, Artificial Sequence
  Description of Artificial Sequence: Synthetic oligonucleotide
cuccuggaccacaagcacc

SEQ ID NO: 604 - RNA, 19 nt, Artificial Sequence
  Description of Artificial Sequence: Synthetic oligonucleotide
uccuggaccacaagcaccu

SEQ ID NO: 605 - RNA, 19 nt, Artificial Sequence
  Description of Artificial Sequence: Synthetic oligonucleotide
ccuggaccacaagcaccua

SEQ ID NO: 606 - RNA, 19 nt, Artificial Sequence
  Description of Artificial Sequence: Synthetic oligonucleotide
cuggaccacaagcaccuag

SEQ ID NO: 607 - RNA, 19 nt, Artificial Sequence
  Description of Artificial Sequence: Synthetic oligonucleotide
uggaccacaagcaccuaga

SEQ ID NO: 608 - RNA, 19 nt, Artificial Sequence
  Description of Artificial Sequence: Synthetic oligonucleotide
ggaccacaagcaccuagac

SEQ ID NO: 609 - RNA, 19 nt, Artificial Sequence
  Description of Artificial Sequence: Synthetic oligonucleotide
gaccacaagcaccuagacc

SEQ ID NO: 610 - RNA, 19 nt, Artificial Sequence
  Description of Artificial Sequence: Synthetic oligonucleotide
accacaagcaccuagacca

SEQ ID NO: 611 - RNA, 19 nt, Artificial Sequence
  Description of Artificial Sequence: Synthetic oligonucleotide
ccacaagcaccuagaccau

SEQ ID NO: 612 - RNA, 19 nt, Artificial Sequence
  Description of Artificial Sequence: Synthetic oligonucleotide
cacaagcaccuagaccaug

SEQ ID NO: 613 - RNA, 19 nt, Artificial Sequence
  Description of Artificial Sequence: Synthetic oligonucleotide
acaagcaccuagaccauga

SEQ ID NO: 614 - RNA, 19 nt, Artificial Sequence
  Description of Artificial Sequence: Synthetic oligonucleotide
caagcaccuagaccaugag

SEQ ID NO: 615 - RNA, 19 nt, Artificial Sequence
  Description of Artificial Sequence: Synthetic oligonucleotide
aagcaccuagaccaugagg

SEQ ID NO: 616 - RNA, 19 nt, Artificial Sequence
  Description of Artificial Sequence: Synthetic oligonucleotide
agcaccuagaccaugaggu

SEQ ID NO: 617 - RNA, 19 nt, Artificial Sequence
  Description of Artificial Sequence: Synthetic oligonucleotide
gcaccuagaccaugaggug

SEQ ID NO: 618 - RNA, 19 nt, Artificial Sequence
  Description of Artificial Sequence: Synthetic oligonucleotide
caccuagaccaugaggugg

SEQ ID NO: 619 - RNA, 19 nt, Artificial Sequence
  Description of Artificial Sequence: Synthetic oligonucleotide
accuagaccaugagguggc

SEQ ID NO: 620 - RNA, 19 nt, Artificial Sequence
  Description of Artificial Sequence: Synthetic oligonucleotide
ccuagaccaugagguggcc

SEQ ID NO: 621 - RNA, 19 nt, Artificial Sequence
  Description of Artificial Sequence: Synthetic oligonucleotide
cuagaccaugagguggcca

SEQ ID NO: 622 - RNA, 19 nt, Artificial Sequence
  Description of Artificial Sequence: Synthetic oligonucleotide
uagaccaugagguggccaa

SEQ ID NO: 623 - RNA, 19 nt, Artificial Sequence
  Description of Artificial Sequence: Synthetic oligonucleotide
agaccaugagguggccaag

SEQ ID NO: 624 - RNA, 19 nt, Artificial Sequence
  Description of Artificial Sequence: Synthetic oligonucleotide
gaccaugagguggccaagc

SEQ ID NO: 625 - RNA, 19 nt, Artificial Sequence
  Description of Artificial Sequence: Synthetic oligonucleotide
accaugagguggccaagcc

SEQ ID NO: 626 - RNA, 19 nt, Artificial Sequence
  Description of Artificial Sequence: Synthetic oligonucleotide
ccaugagguggccaagccu

SEQ ID NO: 627 - RNA, 19 nt, Artificial Sequence
  Description of Artificial Sequence: Synthetic oligonucleotide
caugagguggccaagccug

SEQ ID NO: 628 - RNA, 19 nt, Artificial Sequence
  Description of Artificial Sequence: Synthetic oligonucleotide
augagguggccaagccugc

SEQ ID NO: 629 - RNA, 19 nt, Artificial Sequence
  Description of Artificial Sequence: Synthetic oligonucleotide
ugagguggccaagccugcc

SEQ ID NO: 630 - RNA, 19 nt, Artificial Sequence
  Description of Artificial Sequence: Synthetic oligonucleotide
gagguggccaagccugccc

SEQ ID NO: 631 - RNA, 19 nt, Artificial Sequence
  Description of Artificial Sequence: Synthetic oligonucleotide
agguggccaagccugcccg

SEQ ID NO: 632 - RNA, 19 nt, Artificial Sequence
  Description of Artificial Sequence: Synthetic oligonucleotide
gguggccaagccugcccga

SEQ ID NO: 633 - RNA, 19 nt, Artificial Sequence
  Description of Artificial Sequence: Synthetic oligonucleotide
guggccaagccugcccgaa

SEQ ID NO: 634 - RNA, 19 nt, Artificial Sequence
  Description of Artificial Sequence: Synthetic oligonucleotide
uggccaagccugcccgaag

SEQ ID NO: 635 - RNA, 19 nt, Artificial Sequence
  Description of Artificial Sequence: Synthetic oligonucleotide
ggccaagccugcccgaaga

SEQ ID NO: 636 - RNA, 19 nt, Artificial Sequence
  Description of Artificial Sequence: Synthetic oligonucleotide
gccaagccugcccgaagaa

SEQ ID NO: 637 - RNA, 19 nt, Artificial Sequence
  Description of Artificial Sequence: Synthetic oligonucleotide
ccaagccugcccgaagaaa

SEQ ID NO: 638 - RNA, 19 nt, Artificial Sequence
  Description of Artificial Sequence: Synthetic oligonucleotide
caagccugcccgaagaaag

SEQ ID NO: 639 - RNA, 19 nt, Artificial Sequence
  Description of Artificial Sequence: Synthetic oligonucleotide
aagccugcccgaagaaaga

SEQ ID NO: 640 - RNA, 19 nt, Artificial Sequence
  Description of Artificial Sequence: Synthetic oligonucleotide
agccugcccgaagaaagag

SEQ ID NO: 641 - RNA, 19 nt, Artificial Sequence
  Description of Artificial Sequence: Synthetic oligonucleotide
gccugcccgaagaaagagg

SEQ ID NO: 642 - RNA, 19 nt, Artificial Sequence
  Description of Artificial Sequence: Synthetic oligonucleotide
ccugcccgaagaaagaggc

SEQ ID NO: 643 - RNA, 19 nt, Artificial Sequence
  Description of Artificial Sequence: Synthetic oligonucleotide
cugcccgaagaaagaggcu

SEQ ID NO: 644 - RNA, 19 nt, Artificial Sequence
  Description of Artificial Sequence: Synthetic oligonucleotide
ugcccgaagaaagaggcug

SEQ ID NO: 645 - RNA, 19 nt, Artificial Sequence
  Description of Artificial Sequence: Synthetic oligonucleotide
gcccgaagaaagaggcugc

SEQ ID NO: 646 - RNA, 19 nt, Artificial Sequence
  Description of Artificial Sequence: Synthetic oligonucleotide
cccgaagaaagaggcugcc

SEQ ID NO: 647 - RNA, 19 nt, Artificial Sequence
  Description of Artificial Sequence: Synthetic oligonucleotide
ccgaagaaagaggcugccc

SEQ ID NO: 648 - RNA, 19 nt, Artificial Sequence
  Description of Artificial Sequence: Synthetic oligonucleotide
cgaagaaagaggcugcccg

SEQ ID NO: 649 - RNA, 19 nt, Artificial Sequence
  Description of Artificial Sequence: Synthetic oligonucleotide
gaagaaagaggcugcccga

SEQ ID NO: 650 - RNA, 19 nt, Artificial Sequence
  Description of Artificial Sequence: Synthetic oligonucleotide
aagaaagaggcugcccgag

SEQ ID NO: 651 - RNA, 19 nt, Artificial Sequence
  Description of Artificial Sequence: Synthetic oligonucleotide
agaaagaggcugcccgaga

SEQ ID NO: 652 - RNA, 19 nt, Artificial Sequence
  Description of Artificial Sequence: Synthetic oligonucleotide
gaaagaggcugcccgagau

SEQ ID NO: 653 - RNA, 19 nt, Artificial Sequence
  Description of Artificial Sequence: Synthetic oligonucleotide
aaagaggcugcccgagaug

SEQ ID NO: 654 - RNA, 19 nt, Artificial Sequence
  Description of Artificial Sequence: Synthetic oligonucleotide
aagaggcugcccgagaugg

SEQ ID NO: 655 - RNA, 19 nt, Artificial Sequence
  Description of Artificial Sequence: Synthetic oligonucleotide
agaggcugcccgagauggc

SEQ ID NO: 656 - RNA, 19 nt, Artificial Sequence
  Description of Artificial Sequence: Synthetic oligonucleotide
gaggcugcccgagauggcc

SEQ ID NO: 657 - RNA, 19 nt, Artificial Sequence
  Description of Artificial Sequence: Synthetic oligonucleotide
aggcugcccgagauggccc

SEQ ID NO: 658 - RNA, 19 nt, Artificial Sequence
  Description of Artificial Sequence: Synthetic oligonucleotide
ggcugcccgagauggccca

SEQ ID NO: 659 - RNA, 19 nt, Artificial Sequence
  Description of Artificial Sequence: Synthetic oligonucleotide
gcugcccgagauggcccag

SEQ ID NO: 660 - RNA, 19 nt, Artificial Sequence
  Description of Artificial Sequence: Synthetic oligonucleotide
cugcccgagauggcccagc

SEQ ID NO: 661 - RNA, 19 nt, Artificial Sequence
  Description of Artificial Sequence: Synthetic oligonucleotide
ugcccgagauggcccagcc

SEQ ID NO: 662 - RNA, 19 nt, Artificial Sequence
  Description of Artificial Sequence: Synthetic oligonucleotide
gcccgagauggcccagcca

SEQ ID NO: 663 - RNA, 19 nt, Artificial Sequence
  Description of Artificial Sequence: Synthetic oligonucleotide
cccgagauggcccagccag

SEQ ID NO: 664 - RNA, 19 nt, Artificial Sequence
  Description of Artificial Sequence: Synthetic oligonucleotide
ccgagauggcccagccagu

SEQ ID NO: 665 - RNA, 19 nt, Artificial Sequence
  Description of Artificial Sequence: Synthetic oligonucleotide
cgagauggcccagccaguu

SEQ ID NO: 666 - RNA, 19 nt, Artificial Sequence
  Description of Artificial Sequence: Synthetic oligonucleotide
gagauggcccagccaguug

SEQ ID NO: 667 - RNA, 19 nt, Artificial Sequence
  Description of Artificial Sequence: Synthetic oligonucleotide
agauggcccagccaguuga

SEQ ID NO: 668 - RNA, 19 nt, Artificial Sequence
  Description of Artificial Sequence: Synthetic oligonucleotide
gauggcccagccaguugac

SEQ ID NO: 669 - RNA, 19 nt, Artificial Sequence
  Description of Artificial Sequence: Synthetic oligonucleotide
auggcccagccaguugacc

SEQ ID NO: 670 - RNA, 19 nt, Artificial Sequence
  Description of Artificial Sequence: Synthetic oligonucleotide
uggcccagccaguugaccc

SEQ ID NO: 671 - RNA, 19 nt, Artificial Sequence
  Description of Artificial Sequence: Synthetic oligonucleotide
ggcccagccaguugacccg

SEQ ID NO: 672 - RNA, 19 nt, Artificial Sequence
  Description of Artificial Sequence: Synthetic oligonucleotide
gcccagccaguugacccgg

SEQ ID NO: 673 - RNA, 19 nt, Artificial Sequence
  Description of Artificial Sequence: Synthetic oligonucleotide
cccagccaguugacccggc

SEQ ID NO: 674 - RNA, 19 nt, Artificial Sequence
  Description of Artificial Sequence: Synthetic oligonucleotide
ccagccaguugacccggcu

SEQ ID NO: 675 - RNA, 19 nt, Artificial Sequence
  Description of Artificial Sequence: Synthetic oligonucleotide
cagccaguugacccggcuc

SEQ ID NO: 676 - RNA, 19 nt, Artificial Sequence
  Description of Artificial Sequence: Synthetic oligonucleotide
agccaguugacccggcuca

SEQ ID NO: 677 - RNA, 19 nt, Artificial Sequence
  Description of Artificial Sequence: Synthetic oligonucleotide
gccaguugacccggcucac

SEQ ID NO: 678 - RNA, 19 nt, Artificial Sequence
  Description of Artificial Sequence: Synthetic oligonucleotide
ccaguugacccggcucaca

SEQ ID NO: 679 - RNA, 19 nt, Artificial Sequence
  Description of Artificial Sequence: Synthetic oligonucleotide
caguugacccggcucacaa

SEQ ID NO: 680 - RNA, 19 nt, Artificial Sequence
  Description of Artificial Sequence: Synthetic oligonucleotide
aguugacccggcucacaau

SEQ ID NO: 681 - RNA, 19 nt, Artificial Sequence
  Description of Artificial Sequence: Synthetic oligonucleotide
guugacccggcucacaaug

SEQ ID NO: 682 - RNA, 19 nt, Artificial Sequence
  Description of Artificial Sequence: Synthetic oligonucleotide
uugacccggcucacaaugu

SEQ ID NO: 683 - RNA, 19 nt, Artificial Sequence
  Description of Artificial Sequence: Synthetic oligonucleotide
ugacccggcucacaauguc

SEQ ID NO: 684 - RNA, 19 nt, Artificial Sequence
  Description of Artificial Sequence: Synthetic oligonucleotide
gacccggcucacaauguca

SEQ ID NO: 685 - RNA, 19 nt, Artificial Sequence
  Description of Artificial Sequence: Synthetic oligonucleotide
acccggcucacaaugucag

SEQ ID NO: 686 - RNA, 19 nt, Artificial Sequence
  Description of Artificial Sequence: Synthetic oligonucleotide
cccggcucacaaugucagc

SEQ ID NO: 687 - RNA, 19 nt, Artificial Sequence
  Description of Artificial Sequence: Synthetic oligonucleotide
ccggcucacaaugucagcc

SEQ ID NO: 688 - RNA, 19 nt, Artificial Sequence
  Description of Artificial Sequence: Synthetic oligonucleotide
cggcucacaaugucagccg

SEQ ID NO: 689 - RNA, 19 nt, Artificial Sequence
  Description of Artificial Sequence: Synthetic oligonucleotide
ggcucacaaugucagccgc

SEQ ID NO: 690 - RNA, 19 nt, Artificial Sequence
  Description of Artificial Sequence: Synthetic oligonucleotide
gcucacaaugucagccgcc

SEQ ID NO: 691 - RNA, 19 nt, Artificial Sequence
  Description of Artificial Sequence: Synthetic oligonucleotide
cucacaaugucagccgccu

SEQ ID NO: 692 - RNA, 19 nt, Artificial Sequence
  Description of Artificial Sequence: Synthetic oligonucleotide
ucacaaugucagccgccug

SEQ ID NO: 693 - RNA, 19 nt, Artificial Sequence
  Description of Artificial Sequence: Synthetic oligonucleotide
cacaaugucagccgccugc

SEQ ID NO: 694 - RNA, 19 nt, Artificial Sequence
  Description of Artificial Sequence: Synthetic oligonucleotide
acaaugucagccgccugca

SEQ ID NO: 695 - RNA, 19 nt, Artificial Sequence
  Description of Artificial Sequence: Synthetic oligonucleotide
caaugucagccgccugcac

SEQ ID NO: 696 - RNA, 19 nt, Artificial Sequence
  Description of Artificial Sequence: Synthetic oligonucleotide
aaugucagccgccugcacc

SEQ ID NO: 697 - RNA, 19 nt, Artificial Sequence
  Description of Artificial Sequence: Synthetic oligonucleotide
augucagccgccugcaccg

SEQ ID NO: 698 - RNA, 19 nt, Artificial Sequence
  Description of Artificial Sequence: Synthetic oligonucleotide
ugucagccgccugcaccgg

SEQ ID NO: 699 - RNA, 19 nt, Artificial Sequence
  Description of Artificial Sequence: Synthetic oligonucleotide
gucagccgccugcaccggc

SEQ ID NO: 700 - RNA, 19 nt, Artificial Sequence
  Description of Artificial Sequence: Synthetic oligonucleotide
ucagccgccugcaccggcu

SEQ ID NO: 701 - RNA, 19 nt, Artificial Sequence
  Description of Artificial Sequence: Synthetic oligonucleotide
cagccgccugcaccggcug

SEQ ID NO: 702 - RNA, 19 nt, Artificial Sequence
  Description of Artificial Sequence: Synthetic oligonucleotide
agccgccugcaccggcugc

SEQ ID NO: 703 - RNA, 19 nt, Artificial Sequence
  Description of Artificial Sequence: Synthetic oligonucleotide
gccgccugcaccggcugcc

SEQ ID NO: 704 - RNA, 19 nt, Artificial Sequence
  Description of Artificial Sequence: Synthetic oligonucleotide
ccgccugcaccggcugccc

SEQ ID NO: 705 - RNA, 19 nt, Artificial Sequence
  Description of Artificial Sequence: Synthetic oligonucleotide
cgccugcaccggcugccca

SEQ ID NO: 706 - RNA, 19 nt, Artificial Sequence
  Description of Artificial Sequence: Synthetic oligonucleotide
gccugcaccggcugcccag

SEQ ID NO: 707 - RNA, 19 nt, Artificial Sequence
  Description of Artificial Sequence: Synthetic oligonucleotide
ccugcaccggcugcccagg

SEQ ID NO: 708 - RNA, 19 nt, Artificial Sequence
  Description of Artificial Sequence: Synthetic oligonucleotide
cugcaccggcugcccaggg

SEQ ID NO: 709 - RNA, 19 nt, Artificial Sequence
  Description of Artificial Sequence: Synthetic oligonucleotide
ugcaccggcugcccaggga

SEQ ID NO: 710 - RNA, 19 nt, Artificial Sequence
  Description of Artificial Sequence: Synthetic oligonucleotide
gcaccggcugcccagggau

SEQ ID NO: 711 - RNA, 19 nt, Artificial Sequence
  Description of Artificial Sequence: Synthetic oligonucleotide
caccggcugcccagggauu

SEQ ID NO: 712 - RNA, 19 nt, Artificial Sequence
  Description of Artificial Sequence: Synthetic oligonucleotide
accggcugcccagggauug

SEQ ID NO: 713 - RNA, 19 nt, Artificial Sequence
  Description of Artificial Sequence: Synthetic oligonucleotide
ccggcugcccagggauugc

SEQ ID NO: 714 - RNA, 19 nt, Artificial Sequence
  Description of Artificial Sequence: Synthetic oligonucleotide
cggcugcccagggauugcc

SEQ ID NO: 715 - RNA, 19 nt, Artificial Sequence
  Description of Artificial Sequence: Synthetic oligonucleotide
ggcugcccagggauugcca

SEQ ID NO: 716 - RNA, 19 nt, Artificial Sequence
  Description of Artificial Sequence: Synthetic oligonucleotide
gcugcccagggauugccag

SEQ ID NO: 717 - RNA, 19 nt, Artificial Sequence
  Description of Artificial Sequence: Synthetic oligonucleotide
cugcccagggauugccagg

SEQ ID NO: 718 - RNA, 19 nt, Artificial Sequence
  Description of Artificial Sequence: Synthetic oligonucleotide
ugcccagggauugccagga

SEQ ID NO: 719 - RNA, 19 nt, Artificial Sequence
  Description of Artificial Sequence: Synthetic oligonucleotide
gcccagggauugccaggag

SEQ ID NO: 720 - RNA, 19 nt, Artificial Sequence
  Description of Artificial Sequence: Synthetic oligonucleotide
cccagggauugccaggagc

SEQ ID NO: 721 - RNA, 19 nt, Artificial Sequence
  Description of Artificial Sequence: Synthetic oligonucleotide
ccagggauugccaggagcu

SEQ ID NO: 722 - RNA, 19 nt, Artificial Sequence
  Description of Artificial Sequence: Synthetic oligonucleotide
cagggauugccaggagcug

SEQ ID NO: 723 - RNA, 19 nt, Artificial Sequence
  Description of Artificial Sequence: Synthetic oligonucleotide
agggauugccaggagcugu

SEQ ID NO: 724 - RNA, 19 nt, Artificial Sequence
  Description of Artificial Sequence: Synthetic oligonucleotide
gggauugccaggagcuguu

SEQ ID NO: 725 - RNA, 19 nt, Artificial Sequence
  Description of Artificial Sequence: Synthetic oligonucleotide
ggauugccaggagcuguuc

SEQ ID NO: 726 - RNA, 19 nt, Artificial Sequence
  Description of Artificial Sequence: Synthetic oligonucleotide
gauugccaggagcuguucc

SEQ ID NO: 727 - RNA, 19 nt, Artificial Sequence
  Description of Artificial Sequence: Synthetic oligonucleotide
auugccaggagcuguucca

SEQ ID NO: 728 - RNA, 19 nt, Artificial Sequence
  Description of Artificial Sequence: Synthetic oligonucleotide
uugccaggagcuguuccag

SEQ ID NO: 729 - RNA, 19 nt, Artificial Sequence
  Description of Artificial Sequence: Synthetic oligonucleotide
ugccaggagcuguuccagg

SEQ ID NO: 730 - RNA, 19 nt, Artificial Sequence
  Description of Artificial Sequence: Synthetic oligonucleotide
gccaggagcuguuccaggu

SEQ ID NO: 731 - RNA, 19 nt, Artificial Sequence
  Description of Artificial Sequence: Synthetic oligonucleotide
ccaggagcuguuccagguu

SEQ ID NO: 732 - RNA, 19 nt, Artificial Sequence
  Description of Artificial Sequence: Synthetic oligonucleotide
caggagcuguuccagguug

SEQ ID NO: 733 - RNA, 19 nt, Artificial Sequence
  Description of Artificial Sequence: Synthetic oligonucleotide
aggagcuguuccagguugg

SEQ ID NO: 734 - RNA, 19 nt, Artificial Sequence
  Description of Artificial Sequence: Synthetic oligonucleotide
ggagcuguuccagguuggg

SEQ ID NO: 735 - RNA, 19 nt, Artificial Sequence
  Description of Artificial Sequence: Synthetic oligonucleotide
gagcuguuccagguugggg

SEQ ID NO: 736 - RNA, 19 nt, Artificial Sequence
  Description of Artificial Sequence: Synthetic oligonucleotide
agcuguuccagguugggga

SEQ ID NO: 737 - RNA, 19 nt, Artificial Sequence
  Description of Artificial Sequence: Synthetic oligonucleotide
gcuguuccagguuggggag

SEQ ID NO: 738 - RNA, 19 nt, Artificial Sequence
  Description of Artificial Sequence: Synthetic oligonucleotide
cuguuccagguuggggaga

SEQ ID NO: 739 - RNA, 19 nt, Artificial Sequence
  Description of Artificial Sequence: Synthetic oligonucleotide
uguuccagguuggggagag

SEQ ID NO: 740 - RNA, 19 nt, Artificial Sequence
  Description of Artificial Sequence: Synthetic oligonucleotide
guuccagguuggggagagg

SEQ ID NO: 741 - RNA, 19 nt, Artificial Sequence
  Description of Artificial Sequence: Synthetic oligonucleotide
uuccagguuggggagaggc

SEQ ID NO: 742 - RNA, 19 nt, Artificial Sequence
  Description of Artificial Sequence: Synthetic oligonucleotide
uccagguuggggagaggca

SEQ ID NO: 743 - RNA, 19 nt, Artificial Sequence
  Description of Artificial Sequence: Synthetic oligonucleotide
ccagguuggggagaggcag

SEQ ID NO: 744 - RNA, 19 nt, Artificial Sequence
  Description of Artificial Sequence: Synthetic oligonucleotide
cagguuggggagaggcaga

SEQ ID NO: 745 - RNA, 19 nt, Artificial Sequence
  Description of Artificial Sequence: Synthetic oligonucleotide
agguuggggagaggcagag

SEQ ID NO: 746 - RNA, 19 nt, Artificial Sequence
  Description of Artificial Sequence: Synthetic oligonucleotide
gguuggggagaggcagagu

SEQ ID NO: 747 - RNA, 19 nt, Artificial Sequence
  Description of Artificial Sequence: Synthetic oligonucleotide
guuggggagaggcagagug

SEQ ID NO: 748 - RNA, 19 nt, Artificial Sequence
  Description of Artificial Sequence: Synthetic oligonucleotide
uuggggagaggcagagugg

SEQ ID NO: 749 - RNA, 19 nt, Artificial Sequence
  Description of Artificial Sequence: Synthetic oligonucleotide
uggggagaggcagagugga

SEQ ID NO: 750 - RNA, 19 nt, Artificial Sequence
  Description of Artificial Sequence: Synthetic oligonucleotide
ggggagaggcagaguggac

SEQ ID NO: 751 - RNA, 19 nt, Artificial Sequence
  Description of Artificial Sequence: Synthetic oligonucleotide
gggagaggcagaguggacu

SEQ ID NO: 752 - RNA, 19 nt, Artificial Sequence
  Description of Artificial Sequence: Synthetic oligonucleotide
ggagaggcagaguggacua

SEQ ID NO: 753 - RNA, 19 nt, Artificial Sequence
  Description of Artificial Sequence: Synthetic oligonucleotide
gagaggcagaguggacuau

SEQ ID NO: 754 - RNA, 19 nt, Artificial Sequence
  Description of Artificial Sequence: Synthetic oligonucleotide
agaggcagaguggacuauu

SEQ ID NO: 755 - RNA, 19 nt, Artificial Sequence
  Description of Artificial Sequence: Synthetic oligonucleotide
gaggcagaguggacuauuu

SEQ ID NO: 756 - RNA, 19 nt, Artificial Sequence
  Description of Artificial Sequence: Synthetic oligonucleotide
aggcagaguggacuauuug

SEQ ID NO: 757 - RNA, 19 nt, Artificial Sequence
  Description of Artificial Sequence: Synthetic oligonucleotide
ggcagaguggacuauuuga

SEQ ID NO: 758 - RNA, 19 nt, Artificial Sequence
  Description of Artificial Sequence: Synthetic oligonucleotide
gcagaguggacuauuugaa

SEQ ID NO: 759 - RNA, 19 nt, Artificial Sequence
  Description of Artificial Sequence: Synthetic oligonucleotide
cagaguggacuauuugaaa

SEQ ID NO: 760 - RNA, 19 nt, Artificial Sequence
  Description of Artificial Sequence: Synthetic oligonucleotide
agaguggacuauuugaaau

SEQ ID NO: 761 - RNA, 19 nt, Artificial Sequence
  Description of Artificial Sequence: Synthetic oligonucleotide
gaguggacuauuugaaauc

SEQ ID NO: 762 - RNA, 19 nt, Artificial Sequence
  Description of Artificial Sequence: Synthetic oligonucleotide
aguggacuauuugaaaucc

SEQ ID NO: 763 - RNA, 19 nt, Artificial Sequence
  Description of Artificial Sequence: Synthetic oligonucleotide
guggacuauuugaaaucca

SEQ ID NO: 764 - RNA, 19 nt, Artificial Sequence
  Description of Artificial Sequence: Synthetic oligonucleotide
uggacuauuugaaauccag

SEQ ID NO: 765 - RNA, 19 nt, Artificial Sequence
  Description of Artificial Sequence: Synthetic oligonucleotide
ggacuauuugaaauccagc

SEQ ID NO: 766 - RNA, 19 nt, Artificial Sequence
  Description of Artificial Sequence: Synthetic oligonucleotide
gacuauuugaaauccagcc

SEQ ID NO: 767 - RNA, 19 nt, Artificial Sequence
  Description of Artificial Sequence: Synthetic oligonucleotide
acuauuugaaauccagccu

SEQ ID NO: 768 - RNA, 19 nt, Artificial Sequence
  Description of Artificial Sequence: Synthetic oligonucleotide
cuauuugaaauccagccuc

SEQ ID NO: 769 - RNA, 19 nt, Artificial Sequence
  Description of Artificial Sequence: Synthetic oligonucleotide
uauuugaaauccagccuca

SEQ ID NO: 770 - RNA, 19 nt, Artificial Sequence
  Description of Artificial Sequence: Synthetic oligonucleotide
auuugaaauccagccucag

SEQ ID NO: 771 - RNA, 19 nt, Artificial Sequence
  Description of Artificial Sequence: Synthetic oligonucleotide
uuugaaauccagccucagg

SEQ ID NO: 772 - RNA, 19 nt, Artificial Sequence
  Description of Artificial Sequence: Synthetic oligonucleotide
uugaaauccagccucaggg

SEQ ID NO: 773 - RNA, 19 nt, Artificial Sequence
  Description of Artificial Sequence: Synthetic oligonucleotide
ugaaauccagccucagggg

SEQ ID NO: 774 - RNA, 19 nt, Artificial Sequence
  Description of Artificial Sequence: Synthetic oligonucleotide
gaaauccagccucaggggu

SEQ ID NO: 775 - RNA, 19 nt, Artificial Sequence
  Description of Artificial Sequence: Synthetic oligonucleotide
aaauccagccucagggguc

SEQ ID NO: 776 - RNA, 19 nt, Artificial Sequence
  Description of Artificial Sequence: Synthetic oligonucleotide
aauccagccucaggggucu

SEQ ID NO: 777 - RNA, 19 nt, Artificial Sequence
  Description of Artificial Sequence: Synthetic oligonucleotide
auccagccucaggggucuc

SEQ ID NO: 778 - RNA, 19 nt, Artificial Sequence
  Description of Artificial Sequence: Synthetic oligonucleotide
uccagccucaggggucucc

SEQ ID NO: 779 - RNA, 19 nt, Artificial Sequence
  Description of Artificial Sequence: Synthetic oligonucleotide
ccagccucaggggucuccg

SEQ ID NO: 780 - RNA, 19 nt, Artificial Sequence
  Description of Artificial Sequence: Synthetic oligonucleotide
cagccucaggggucuccgc

SEQ ID NO: 781 - RNA, 19 nt, Artificial Sequence
  Description of Artificial Sequence: Synthetic oligonucleotide
agccucaggggucuccgcc

SEQ ID NO: 782 - RNA, 19 nt, Artificial Sequence
  Description of Artificial Sequence: Synthetic oligonucleotide
gccucaggggucuccgcca

SEQ ID NO: 783 - RNA, 19 nt, Artificial Sequence
  Description of Artificial Sequence: Synthetic oligonucleotide
ccucaggggucuccgccau

SEQ ID NO: 784 - RNA, 19 nt, Artificial Sequence
  Description of Artificial Sequence: Synthetic oligonucleotide
cucaggggucuccgccauu

SEQ ID NO: 785 - RNA, 19 nt, Artificial Sequence
  Description of Artificial Sequence: Synthetic oligonucleotide
ucaggggucuccgccauuu

SEQ ID NO: 786 - RNA, 19 nt, Artificial Sequence
  Description of Artificial Sequence: Synthetic oligonucleotide
caggggucuccgccauuuu

SEQ ID NO: 787 - RNA, 19 nt, Artificial Sequence
  Description of Artificial Sequence: Synthetic oligonucleotide
aggggucuccgccauuuuu

SEQ ID NO: 788 - RNA, 19 nt, Artificial Sequence
  Description of Artificial Sequence: Synthetic oligonucleotide
ggggucuccgccauuuuug

SEQ ID NO: 789 - RNA, 19 nt, Artificial Sequence
  Description of Artificial Sequence: Synthetic oligonucleotide
gggucuccgccauuuuugg

SEQ ID NO: 790 - RNA, 19 nt, Artificial Sequence
  Description of Artificial Sequence: Synthetic oligonucleotide
ggucuccgccauuuuuggu

SEQ ID NO: 791 - RNA, 19 nt, Artificial Sequence
  Description of Artificial Sequence: Synthetic oligonucleotide
gucuccgccauuuuuggug

SEQ ID NO: 792 - RNA, 19 nt, Artificial Sequence
  Description of Artificial Sequence: Synthetic oligonucleotide
ucuccgccauuuuugguga

SEQ ID NO: 793 - RNA, 19 nt, Artificial Sequence
  Description of Artificial Sequence: Synthetic oligonucleotide
cuccgccauuuuuggugaa

SEQ ID NO: 794 - RNA, 19 nt, Artificial Sequence
  Description of Artificial Sequence: Synthetic oligonucleotide
uccgccauuuuuggugaac

SEQ ID NO: 795 - RNA, 19 nt, Artificial Sequence
  Description of Artificial Sequence: Synthetic oligonucleotide
ccgccauuuuuggugaacu

SEQ ID NO: 796 - RNA, 19 nt, Artificial Sequence
  Description of Artificial Sequence: Synthetic oligonucleotide
cgccauuuuuggugaacug

SEQ ID NO: 797 - RNA, 19 nt, Artificial Sequence
  Description of Artificial Sequence: Synthetic oligonucleotide
gccauuuuuggugaacugc

SEQ ID NO: 798 - RNA, 19 nt, Artificial Sequence
  Description of Artificial Sequence: Synthetic oligonucleotide
ccauuuuuggugaacugca

SEQ ID NO: 799 - RNA, 19 nt, Artificial Sequence
  Description of Artificial Sequence: Synthetic oligonucleotide
cauuuuuggugaacugcaa

SEQ ID NO: 800 - RNA, 19 nt, Artificial Sequence
  Description of Artificial Sequence: Synthetic oligonucleotide
auuuuuggugaacugcaag

SEQ ID NO: 801 - RNA, 19 nt, Artificial Sequence
  Description of Artificial Sequence: Synthetic oligonucleotide
uuuuuggugaacugcaaga

SEQ ID NO: 802 - RNA, 19 nt, Artificial Sequence
  Description of Artificial Sequence: Synthetic oligonucleotide
uuuuggugaacugcaagau

SEQ ID NO: 803 - RNA, 19 nt, Artificial Sequence
  Description of Artificial Sequence: Synthetic oligonucleotide
uuuggugaacugcaagaug

SEQ ID NO: 804 - RNA, 19 nt, Artificial Sequence
  Description of Artificial Sequence: Synthetic oligonucleotide
uuggugaacugcaagauga

SEQ ID NO: 805 - RNA, 19 nt, Artificial Sequence
  Description of Artificial Sequence: Synthetic oligonucleotide
uggugaacugcaagaugac

SEQ ID NO: 806 - RNA, 19 nt, Artificial Sequence
  Description of Artificial Sequence: Synthetic oligonucleotide
ggugaacugcaagaugacc

SEQ ID NO: 807 - RNA, 19 nt, Artificial Sequence
  Description of Artificial Sequence: Synthetic oligonucleotide
gugaacugcaagaugaccu

SEQ ID NO: 808 - RNA, 19 nt, Artificial Sequence
  Description of Artificial Sequence: Synthetic oligonucleotide
ugaacugcaagaugaccuc

SEQ ID NO: 809 - RNA, 19 nt, Artificial Sequence
  Description of Artificial Sequence: Synthetic oligonucleotide
gaacugcaagaugaccuca

SEQ ID NO: 810 - RNA, 19 nt, Artificial Sequence
  Description of Artificial Sequence: Synthetic oligonucleotide
aacugcaagaugaccucag

SEQ ID NO: 811 - RNA, 19 nt, Artificial Sequence
  Description of Artificial Sequence: Synthetic oligonucleotide
acugcaagaugaccucaga

SEQ ID NO: 812 - RNA, 19 nt, Artificial Sequence
  Description of Artificial Sequence: Synthetic oligonucleotide
cugcaagaugaccucagau

SEQ ID NO: 813 - RNA, 19 nt, Artificial Sequence
  Description of Artificial Sequence: Synthetic oligonucleotide
ugcaagaugaccucagaug

SEQ ID NO: 814 - RNA, 19 nt, Artificial Sequence
  Description of Artificial Sequence: Synthetic oligonucleotide
gcaagaugaccucagaugg

SEQ ID NO: 815 - RNA, 19 nt, Artificial Sequence
  Description of Artificial Sequence: Synthetic oligonucleotide
caagaugaccucagaugga

SEQ ID NO: 816 - RNA, 19 nt, Artificial Sequence
  Description of Artificial Sequence: Synthetic oligonucleotide
aagaugaccucagauggag

SEQ ID NO: 817 - RNA, 19 nt, Artificial Sequence
  Description of Artificial Sequence: Synthetic oligonucleotide
agaugaccucagauggagg

SEQ ID NO: 818 - RNA, 19 nt, Artificial Sequence
  Description of Artificial Sequence: Synthetic oligonucleotide
gaugaccucagauggaggc

SEQ ID NO: 819 - RNA, 19 nt, Artificial Sequence
  Description of Artificial Sequence: Synthetic oligonucleotide
augaccucagauggaggcu

SEQ ID NO: 820 - RNA, 19 nt, Artificial Sequence
  Description of Artificial Sequence: Synthetic oligonucleotide
ugaccucagauggaggcug

SEQ ID NO: 821 - RNA, 19 nt, Artificial Sequence
  Description of Artificial Sequence: Synthetic oligonucleotide
gaccucagauggaggcugg

SEQ ID NO: 822 - RNA, 19 nt, Artificial Sequence
  Description of Artificial Sequence: Synthetic oligonucleotide
accucagauggaggcugga

SEQ ID NO: 823 - RNA, 19 nt, Artificial Sequence
  Description of Artificial Sequence: Synthetic oligonucleotide
ccucagauggaggcuggac

SEQ ID NO: 824 - RNA, 19 nt, Artificial Sequence
  Description of Artificial Sequence: Synthetic oligonucleotide
cucagauggaggcuggaca

SEQ ID NO: 825 - RNA, 19 nt, Artificial Sequence
  Description of Artificial Sequence: Synthetic oligonucleotide
ucagauggaggcuggacag

SEQ ID NO: 826 - RNA, 19 nt, Artificial Sequence
  Description of Artificial Sequence: Synthetic oligonucleotide
cagauggaggcuggacagu

SEQ ID NO: 827 - RNA, 19 nt, Artificial Sequence
  Description of Artificial Sequence: Synthetic oligonucleotide
agauggaggcuggacagua

SEQ ID NO: 828 - RNA, 19 nt, Artificial Sequence
  Description of Artificial Sequence: Synthetic oligonucleotide
gauggaggcuggacaguaa

SEQ ID NO: 829 - RNA, 19 nt, Artificial Sequence
  Description of Artificial Sequence: Synthetic oligonucleotide
auggaggcuggacaguaau

SEQ ID NO: 830 - RNA, 19 nt, Artificial Sequence
  Description of Artificial Sequence: Synthetic oligonucleotide
uggaggcuggacaguaauu

SEQ ID NO: 831 - RNA, 19 nt, Artificial Sequence
  Description of Artificial Sequence: Synthetic oligonucleotide
ggaggcuggacaguaauuc

SEQ ID NO: 832 - RNA, 19 nt, Artificial Sequence
  Description of Artificial Sequence: Synthetic oligonucleotide
gaggcuggacaguaauuca

SEQ ID NO: 833 - RNA, 19 nt, Artificial Sequence
  Description of Artificial Sequence: Synthetic oligonucleotide
aggcuggacaguaauucag

SEQ ID NO: 834 - RNA, 19 nt, Artificial Sequence
  Description of Artificial Sequence: Synthetic oligonucleotide
ggcuggacaguaauucaga

SEQ ID NO: 835 - RNA, 19 nt, Artificial Sequence
  Description of Artificial Sequence: Synthetic oligonucleotide
gcuggacaguaauucagag

SEQ ID NO: 836 - RNA, 19 nt, Artificial Sequence
  Description of Artificial Sequence: Synthetic oligonucleotide
cuggacaguaauucagagg

SEQ ID NO: 837 - RNA, 19 nt, Artificial Sequence
  Description of Artificial Sequence: Synthetic oligonucleotide
uggacaguaauucagaggc

SEQ ID NO: 838 - RNA, 19 nt, Artificial Sequence
  Description of Artificial Sequence: Synthetic oligonucleotide
ggacaguaauucagaggcg

SEQ ID NO: 839 - RNA, 19 nt, Artificial Sequence
  Description of Artificial Sequence: Synthetic oligonucleotide
gacaguaauucagaggcgc

SEQ ID NO: 840 - RNA, 19 nt, Artificial Sequence
  Description of Artificial Sequence: Synthetic oligonucleotide
acaguaauucagaggcgcc

SEQ ID NO: 841 - RNA, 19 nt, Artificial Sequence
  Description of Artificial Sequence: Synthetic oligonucleotide
caguaauucagaggcgcca

SEQ ID NO: 842 - RNA, 19 nt, Artificial Sequence
  Description of Artificial Sequence: Synthetic oligonucleotide
aguaauucagaggcgccac

SEQ ID NO: 843 - RNA, 19 nt, Artificial Sequence
  Description of Artificial Sequence: Synthetic oligonucleotide
guaauucagaggcgccacg

SEQ ID NO: 844 - RNA, 19 nt, Artificial Sequence
  Description of Artificial Sequence: Synthetic oligonucleotide
uaauucagaggcgccacga

SEQ ID NO: 845 - RNA, 19 nt, Artificial Sequence
  Description of Artificial Sequence: Synthetic oligonucleotide
aauucagaggcgccacgau

SEQ ID NO: 846 - RNA, 19 nt, Artificial Sequence
  Description of Artificial Sequence: Synthetic oligonucleotide
auucagaggcgccacgaug

SEQ ID NO: 847 - RNA, 19 nt, Artificial Sequence
  Description of Artificial Sequence: Synthetic oligonucleotide
uucagaggcgccacgaugg

SEQ ID NO: 848 - RNA, 19 nt, Artificial Sequence
  Description of Artificial Sequence: Synthetic oligonucleotide
ucagaggcgccacgauggc

SEQ ID NO: 849 - RNA, 19 nt, Artificial Sequence
  Description of Artificial Sequence: Synthetic oligonucleotide
cagaggcgccacgauggcu

SEQ ID NO: 850 - RNA, 19 nt, Artificial Sequence
  Description of Artificial Sequence: Synthetic oligonucleotide
agaggcgccacgauggcuc

SEQ ID NO: 851 - RNA, 19 nt, Artificial Sequence
  Description of Artificial Sequence: Synthetic oligonucleotide
gaggcgccacgauggcuca

SEQ ID NO: 852 - RNA, 19 nt, Artificial Sequence
  Description of Artificial Sequence: Synthetic oligonucleotide
aggcgccacgauggcucag

SEQ ID NO: 853 - RNA, 19 nt, Artificial Sequence
  Description of Artificial Sequence: Synthetic oligonucleotide
ggcgccacgauggcucagu

SEQ ID NO: 854 - RNA, 19 nt, Artificial Sequence
  Description of Artificial Sequence: Synthetic oligonucleotide
gcgccacgauggcucagug

SEQ ID NO: 855 - RNA, 19 nt, Artificial Sequence
  Description of Artificial Sequence: Synthetic oligonucleotide
cgccacgauggcucagugg

SEQ ID NO: 856 - RNA, 19 nt, Artificial Sequence
  Description of Artificial Sequence: Synthetic oligonucleotide
gccacgauggcucagugga

SEQ ID NO: 857 - RNA, 19 nt, Artificial Sequence
  Description of Artificial Sequence: Synthetic oligonucleotide
ccacgauggcucaguggac

SEQ ID NO: 858 - RNA, 19 nt, Artificial Sequence
  Description of Artificial Sequence: Synthetic oligonucleotide
cacgauggcucaguggacu

SEQ ID NO: 859 - RNA, 19 nt, Artificial Sequence
  Description of Artificial Sequence: Synthetic oligonucleotide
acgauggcucaguggacuu

SEQ ID NO: 860 - RNA, 19 nt, Artificial Sequence
  Description of Artificial Sequence: Synthetic oligonucleotide
cgauggcucaguggacuuc

SEQ ID NO: 861 - RNA, 19 nt, Artificial Sequence
  Description of Artificial Sequence: Synthetic oligonucleotide
gauggcucaguggacuuca

SEQ ID NO: 862 - RNA, 19 nt, Artificial Sequence
  Description of Artificial Sequence: Synthetic oligonucleotide
auggcucaguggacuucaa

SEQ ID NO: 863 - RNA, 19 nt, Artificial Sequence
  Description of Artificial Sequence: Synthetic oligonucleotide
uggcucaguggacuucaac

SEQ ID NO: 864 - RNA, 19 nt, Artificial Sequence
  Description of Artificial Sequence: Synthetic oligonucleotide
ggcucaguggacuucaacc

SEQ ID NO: 865 - RNA, 19 nt, Artificial Sequence
  Description of Artificial Sequence: Synthetic oligonucleotide
gcucaguggacuucaaccg

SEQ ID NO: 866 - RNA, 19 nt, Artificial Sequence
  Description of Artificial Sequence: Synthetic oligonucleotide
cucaguggacuucaaccgg

SEQ ID NO: 867 - RNA, 19 nt, Artificial Sequence
  Description of Artificial Sequence: Synthetic oligonucleotide
ucaguggacuucaaccggc

SEQ ID NO: 868 - RNA, 19 nt, Artificial Sequence
  Description of Artificial Sequence: Synthetic oligonucleotide
caguggacuucaaccggcc

SEQ ID NO: 869 - RNA, 19 nt, Artificial Sequence
  Description of Artificial Sequence: Synthetic oligonucleotide
aguggacuucaaccggccc

SEQ ID NO: 870 - RNA, 19 nt, Artificial Sequence
  Description of Artificial Sequence: Synthetic oligonucleotide
guggacuucaaccggcccu

SEQ ID NO: 871 - RNA, 19 nt, Artificial Sequence
  Description of Artificial Sequence: Synthetic oligonucleotide
uggacuucaaccggcccug

SEQ ID NO: 872 - RNA, 19 nt, Artificial Sequence
  Description of Artificial Sequence: Synthetic oligonucleotide
ggacuucaaccggcccugg

SEQ ID NO: 873 - RNA, 19 nt, Artificial Sequence
  Description of Artificial Sequence: Synthetic oligonucleotide
gacuucaaccggcccuggg

SEQ ID NO: 874 - RNA, 19 nt, Artificial Sequence
  Description of Artificial Sequence: Synthetic oligonucleotide
acuucaaccggcccuggga

SEQ ID NO: 875 - RNA, 19 nt, Artificial Sequence
  Description of Artificial Sequence: Synthetic oligonucleotide
cuucaaccggcccugggaa

SEQ ID NO: 876 - RNA, 19 nt, Artificial Sequence
  Description of Artificial Sequence: Synthetic oligonucleotide
uucaaccggcccugggaag

SEQ ID NO: 877 - RNA, 19 nt, Artificial Sequence
  Description of Artificial Sequence: Synthetic oligonucleotide
ucaaccggcccugggaagc

SEQ ID NO: 878 - RNA, 19 nt, Artificial Sequence
  Description of Artificial Sequence: Synthetic oligonucleotide
caaccggcccugggaagcc

SEQ ID NO: 879 - RNA, 19 nt, Artificial Sequence
  Description of Artificial Sequence: Synthetic oligonucleotide
aaccggcccugggaagccu

SEQ ID NO: 880 - RNA, 19 nt, Artificial Sequence
  Description of Artificial Sequence: Synthetic oligonucleotide
accggcccugggaagccua

SEQ ID NO: 881 - RNA, 19 nt, Artificial Sequence
  Description of Artificial Sequence: Synthetic oligonucleotide
ccggcccugggaagccuac

SEQ ID NO: 882 - RNA, 19 nt, Artificial Sequence
  Description of Artificial Sequence: Synthetic oligonucleotide
cggcccugggaagccuaca

SEQ ID NO: 883 - RNA, 19 nt, Artificial Sequence
  Description of Artificial Sequence: Synthetic oligonucleotide
ggcccugggaagccuacaa

SEQ ID NO: 884 - RNA, 19 nt, Artificial Sequence
  Description of Artificial Sequence: Synthetic oligonucleotide
gcccugggaagccuacaag

SEQ ID NO: 885 - RNA, 19 nt, Artificial Sequence
  Description of Artificial Sequence: Synthetic oligonucleotide
cccugggaagccuacaagg

SEQ ID NO: 886 - RNA, 19 nt, Artificial Sequence
  Description of Artificial Sequence: Synthetic oligonucleotide
ccugggaagccuacaaggc

SEQ ID NO: 887 - RNA, 19 nt, Artificial Sequence
  Description of Artificial Sequence: Synthetic oligonucleotide
cugggaagccuacaaggcg

SEQ ID NO: 888 - RNA, 19 nt, Artificial Sequence
  Description of Artificial Sequence: Synthetic oligonucleotide
ugggaagccuacaaggcgg

SEQ ID NO: 889 - RNA, 19 nt, Artificial Sequence
  Description of Artificial Sequence: Synthetic oligonucleotide
gggaagccuacaaggcggg

SEQ ID NO: 890 - RNA, 19 nt, Artificial Sequence
  Description of Artificial Sequence: Synthetic oligonucleotide
ggaagccuacaaggcgggg

SEQ ID NO: 891 - RNA, 19 nt, Artificial Sequence
  Description of Artificial Sequence: Synthetic oligonucleotide
gaagccuacaaggcggggu

SEQ ID NO: 892 - RNA, 19 nt, Artificial Sequence
  Description of Artificial Sequence: Synthetic oligonucleotide
aagccuacaaggcgggguu

SEQ ID NO: 893 - RNA, 19 nt, Artificial Sequence
  Description of Artificial Sequence: Synthetic oligonucleotide
agccuacaaggcgggguuu

SEQ ID NO: 894 - RNA, 19 nt, Artificial Sequence
  Description of Artificial Sequence: Synthetic oligonucleotide
gccuacaaggcgggguuug

SEQ ID NO: 895 - RNA, 19 nt, Artificial Sequence
  Description of Artificial Sequence: Synthetic oligonucleotide
ccuacaaggcgggguuugg

SEQ ID NO: 896 - RNA, 19 nt, Artificial Sequence
  Description of Artificial Sequence: Synthetic oligonucleotide
cuacaaggcgggguuuggg

SEQ ID NO: 897 - RNA, 19 nt, Artificial Sequence
  Description of Artificial Sequence: Synthetic oligonucleotide
uacaaggcgggguuugggg

SEQ ID NO: 898 - RNA, 19 nt, Artificial Sequence
  Description of Artificial Sequence: Synthetic oligonucleotide
acaaggcgggguuugggga

SEQ ID NO: 899 - RNA, 19 nt, Artificial Sequence
  Description of Artificial Sequence: Synthetic oligonucleotide
caaggcgggguuuggggau

SEQ ID NO: 900 - RNA, 19 nt, Artificial Sequence
  Description of Artificial Sequence: Synthetic oligonucleotide
aaggcgggguuuggggauc

SEQ ID NO: 901 - RNA, 19 nt, Artificial Sequence
  Description of Artificial Sequence: Synthetic oligonucleotide
aggcgggguuuggggaucc

SEQ ID NO: 902 - RNA, 19 nt, Artificial Sequence
  Description of Artificial Sequence: Synthetic oligonucleotide
ggcgggguuuggggauccc

SEQ ID NO: 903 - RNA, 19 nt, Artificial Sequence
  Description of Artificial Sequence: Synthetic oligonucleotide
gcgggguuuggggaucccc

SEQ ID NO: 904 - RNA, 19 nt, Artificial Sequence
  Description of Artificial Sequence: Synthetic oligonucleotide
cgggguuuggggaucccca

SEQ ID NO: 905 - RNA, 19 nt, Artificial Sequence
  Description of Artificial Sequence: Synthetic oligonucleotide
gggguuuggggauccccac

SEQ ID NO: 906 - RNA, 19 nt, Artificial Sequence
  Description of Artificial Sequence: Synthetic oligonucleotide
ggguuuggggauccccacg

SEQ ID NO: 907 - RNA, 19 nt, Artificial Sequence
  Description of Artificial Sequence: Synthetic oligonucleotide
gguuuggggauccccacgg

SEQ ID NO: 908 - RNA, 19 nt, Artificial Sequence
  Description of Artificial Sequence: Synthetic oligonucleotide
guuuggggauccccacggc

SEQ ID NO: 909 - RNA, 19 nt, Artificial Sequence
  Description of Artificial Sequence: Synthetic oligonucleotide
uuuggggauccccacggcg

SEQ ID NO: 910 - RNA, 19 nt, Artificial Sequence
  Description of Artificial Sequence: Synthetic oligonucleotide
uuggggauccccacggcga

SEQ ID NO: 911 - RNA, 19 nt, Artificial Sequence
  Description of Artificial Sequence: Synthetic oligonucleotide
uggggauccccacggcgag

SEQ ID NO: 912 - RNA, 19 nt, Artificial Sequence
  Description of Artificial Sequence: Synthetic oligonucleotide
ggggauccccacggcgagu

SEQ ID NO: 913 - RNA, 19 nt, Artificial Sequence
  Description of Artificial Sequence: Synthetic oligonucleotide
gggauccccacggcgaguu

SEQ ID NO: 914 - RNA, 19 nt, Artificial Sequence
  Description of Artificial Sequence: Synthetic oligonucleotide
ggauccccacggcgaguuc

SEQ ID NO: 915 - RNA, 19 nt, Artificial Sequence
  Description of Artificial Sequence: Synthetic oligonucleotide
gauccccacggcgaguucu

SEQ ID NO: 916 - RNA, 19 nt, Artificial Sequence
  Description of Artificial Sequence: Synthetic oligonucleotide
auccccacggcgaguucug

SEQ ID NO: 917 - RNA, 19 nt, Artificial Sequence
  Description of Artificial Sequence: Synthetic oligonucleotide
uccccacggcgaguucugg

SEQ ID NO: 918 - RNA, 19 nt, Artificial Sequence
  Description of Artificial Sequence: Synthetic oligonucleotide
ccccacggcgaguucuggc

SEQ ID NO: 919 - RNA, 19 nt, Artificial Sequence
  Description of Artificial Sequence: Synthetic oligonucleotide
cccacggcgaguucuggcu

SEQ ID NO: 920 - RNA, 19 nt, Artificial Sequence
  Description of Artificial Sequence: Synthetic oligonucleotide
ccacggcgaguucuggcug

SEQ ID NO: 921 - RNA, 19 nt, Artificial Sequence
  Description of Artificial Sequence: Synthetic oligonucleotide
cacggcgaguucuggcugg

SEQ ID NO: 922 - RNA, 19 nt, Artificial Sequence
  Description of Artificial Sequence: Synthetic oligonucleotide
acggcgaguucuggcuggg

SEQ ID NO: 923 - RNA, 19 nt, Artificial Sequence
  Description of Artificial Sequence: Synthetic oligonucleotide
cggcgaguucuggcugggu

SEQ ID NO: 924 - RNA, 19 nt, Artificial Sequence
  Description of Artificial Sequence: Synthetic oligonucleotide
ggcgaguucuggcuggguc

SEQ ID NO: 925 - RNA, 19 nt, Artificial Sequence
  Description of Artificial Sequence: Synthetic oligonucleotide
gcgaguucuggcugggucu

SEQ ID NO: 926 - RNA, 19 nt, Artificial Sequence
  Description of Artificial Sequence: Synthetic oligonucleotide
cgaguucuggcugggucug

SEQ ID NO: 927 - RNA, 19 nt, Artificial Sequence
  Description of Artificial Sequence: Synthetic oligonucleotide
gaguucuggcugggucugg

SEQ ID NO: 928 - RNA, 19 nt, Artificial Sequence
  Description of Artificial Sequence: Synthetic oligonucleotide
aguucuggcugggucugga

SEQ ID NO: 929 - RNA, 19 nt, Artificial Sequence
  Description of Artificial Sequence: Synthetic oligonucleotide
guucuggcugggucuggag

SEQ ID NO: 930 - RNA, 19 nt, Artificial Sequence
  Description of Artificial Sequence: Synthetic oligonucleotide
uucuggcugggucuggaga

SEQ ID NO: 931 - RNA, 19 nt, Artificial Sequence
  Description of Artificial Sequence: Synthetic oligonucleotide
ucuggcugggucuggagaa

SEQ ID NO: 932 - RNA, 19 nt, Artificial Sequence
  Description of Artificial Sequence: Synthetic oligonucleotide
cuggcugggucuggagaag

SEQ ID NO: 933 - RNA, 19 nt, Artificial Sequence
  Description of Artificial Sequence: Synthetic oligonucleotide
uggcugggucuggagaagg

SEQ ID NO: 934 - RNA, 19 nt, Artificial Sequence
  Description of Artificial Sequence: Synthetic oligonucleotide
ggcugggucuggagaaggu

SEQ ID NO: 935 - RNA, 19 nt, Artificial Sequence
  Description of Artificial Sequence: Synthetic oligonucleotide
gcugggucuggagaaggug

SEQ ID NO: 936 - RNA, 19 nt, Artificial Sequence
  Description of Artificial Sequence: Synthetic oligonucleotide
cugggucuggagaaggugc

SEQ ID NO: 937 - RNA, 19 nt, Artificial Sequence
  Description of Artificial Sequence: Synthetic oligonucleotide
ugggucuggagaaggugca

SEQ ID NO: 938 - RNA, 19 nt, Artificial Sequence
  Description of Artificial Sequence: Synthetic oligonucleotide
gggucuggagaaggugcau

SEQ ID NO: 939 - RNA, 19 nt, Artificial Sequence
  Description of Artificial Sequence: Synthetic oligonucleotide
ggucuggagaaggugcaua

SEQ ID NO: 940 - RNA, 19 nt, Artificial Sequence
  Description of Artificial Sequence: Synthetic oligonucleotide
gucuggagaaggugcauag

SEQ ID NO: 941 - RNA, 19 nt, Artificial Sequence
  Description of Artificial Sequence: Synthetic oligonucleotide
ucuggagaaggugcauagc

SEQ ID NO: 942 - RNA, 19 nt, Artificial Sequence
  Description of Artificial Sequence: Synthetic oligonucleotide
cuggagaaggugcauagca

SEQ ID NO: 943 - RNA, 19 nt, Artificial Sequence
  Description of Artificial Sequence: Synthetic oligonucleotide
uggagaaggugcauagcau

SEQ ID NO: 944 - RNA, 19 nt, Artificial Sequence
  Description of Artificial Sequence: Synthetic oligonucleotide
ggagaaggugcauagcauc

SEQ ID NO: 945 - RNA, 19 nt, Artificial Sequence
  Description of Artificial Sequence: Synthetic oligonucleotide
gagaaggugcauagcauca

SEQ ID NO: 946 - RNA, 19 nt, Artificial Sequence
  Description of Artificial Sequence: Synthetic oligonucleotide
agaaggugcauagcaucac

SEQ ID NO: 947 - RNA, 19 nt, Artificial Sequence
  Description of Artificial Sequence: Synthetic oligonucleotide
gaaggugcauagcaucacg

SEQ ID NO: 948 - RNA, 19 nt, Artificial Sequence
  Description of Artificial Sequence: Synthetic oligonucleotide
aaggugcauagcaucacgg

SEQ ID NO: 949 - RNA, 19 nt, Artificial Sequence
  Description of Artificial Sequence: Synthetic oligonucleotide
aggugcauagcaucacggg

SEQ ID NO: 950 - RNA, 19 nt, Artificial Sequence
  Description of Artificial Sequence: Synthetic oligonucleotide
ggugcauagcaucacgggg

SEQ ID NO: 951 - RNA, 19 nt, Artificial Sequence
  Description of Artificial Sequence: Synthetic oligonucleotide
gugcauagcaucacggggg

SEQ ID NO: 952 - RNA, 19 nt, Artificial Sequence
  Description of Artificial Sequence: Synthetic oligonucleotide
ugcauagcaucacggggga

SEQ ID NO: 953 - RNA, 19 nt, Artificial Sequence
  Description of Artificial Sequence: Synthetic oligonucleotide
gcauagcaucacgggggac

SEQ ID NO: 954 - RNA, 19 nt, Artificial Sequence
  Description of Artificial Sequence: Synthetic oligonucleotide
cauagcaucacgggggacc

SEQ ID NO: 955 - RNA, 19 nt, Artificial Sequence
  Description of Artificial Sequence: Synthetic oligonucleotide
auagcaucacgggggaccg

SEQ ID NO: 956 - RNA, 19 nt, Artificial Sequence
  Description of Artificial Sequence: Synthetic oligonucleotide
uagcaucacgggggaccgc

SEQ ID NO: 957 - RNA, 19 nt, Artificial Sequence
  Description of Artificial Sequence: Synthetic oligonucleotide
agcaucacgggggaccgca

SEQ ID NO: 958 - RNA, 19 nt, Artificial Sequence
  Description of Artificial Sequence: Synthetic oligonucleotide
gcaucacgggggaccgcaa

SEQ ID NO: 959 - RNA, 19 nt, Artificial Sequence
  Description of Artificial Sequence: Synthetic oligonucleotide
caucacgggggaccgcaac

SEQ ID NO: 960 - RNA, 19 nt, Artificial Sequence
  Description of Artificial Sequence: Synthetic oligonucleotide
aucacgggggaccgcaaca

SEQ ID NO: 961 - RNA, 19 nt, Artificial Sequence
  Description of Artificial Sequence: Synthetic oligonucleotide
ucacgggggaccgcaacag

SEQ ID NO: 962 - RNA, 19 nt, Artificial Sequence
  Description of Artificial Sequence: Synthetic oligonucleotide
cacgggggaccgcaacagc

SEQ ID NO: 963 - RNA, 19 nt, Artificial Sequence
  Description of Artificial Sequence: Synthetic oligonucleotide
acgggggaccgcaacagcc

SEQ ID NO: 964 - RNA, 19 nt, Artificial Sequence
  Description of Artificial Sequence: Synthetic oligonucleotide
cgggggaccgcaacagccg

SEQ ID NO: 965 - RNA, 19 nt, Artificial Sequence
  Description of Artificial Sequence: Synthetic oligonucleotide
gggggaccgcaacagccgc

SEQ ID NO: 966 - RNA, 19 nt, Artificial Sequence
  Description of Artificial Sequence: Synthetic oligonucleotide
ggggaccgcaacagccgcc

SEQ ID NO: 967 - RNA, 19 nt, Artificial Sequence
  Description of Artificial Sequence: Synthetic oligonucleotide
gggaccgcaacagccgccu

SEQ ID NO: 968 - RNA, 19 nt, Artificial Sequence
  Description of Artificial Sequence: Synthetic oligonucleotide
ggaccgcaacagccgccug

SEQ ID NO: 969 - RNA, 19 nt, Artificial Sequence
  Description of Artificial Sequence: Synthetic oligonucleotide
gaccgcaacagccgccugg

SEQ ID NO: 970 - RNA, 19 nt, Artificial Sequence
  Description of Artificial Sequence: Synthetic oligonucleotide
accgcaacagccgccuggc

SEQ ID NO: 971 - RNA, 19 nt, Artificial Sequence
  Description of Artificial Sequence: Synthetic oligonucleotide
ccgcaacagccgccuggcc

SEQ ID NO: 972 - RNA, 19 nt, Artificial Sequence
  Description of Artificial Sequence: Synthetic oligonucleotide
cgcaacagccgccuggccg

SEQ ID NO: 973 - RNA, 19 nt, Artificial Sequence
  Description of Artificial Sequence: Synthetic oligonucleotide
gcaacagccgccuggccgu

SEQ ID NO: 974 - RNA, 19 nt, Artificial Sequence
  Description of Artificial Sequence: Synthetic oligonucleotide
caacagccgccuggccgug

SEQ ID NO: 975 - RNA, 19 nt, Artificial Sequence
  Description of Artificial Sequence: Synthetic oligonucleotide
aacagccgccuggccgugc

SEQ ID NO: 976 - RNA, 19 nt, Artificial Sequence
  Description of Artificial Sequence: Synthetic oligonucleotide
acagccgccuggccgugca

SEQ ID NO: 977 - RNA, 19 nt, Artificial Sequence
  Description of Artificial Sequence: Synthetic oligonucleotide
cagccgccuggccgugcag

SEQ ID NO: 978 - RNA, 19 nt, Artificial Sequence
  Description of Artificial Sequence: Synthetic oligonucleotide
agccgccuggccgugcagc

SEQ ID NO: 979 - RNA, 19 nt, Artificial Sequence
  Description of Artificial Sequence: Synthetic oligonucleotide
gccgccuggccgugcagcu

SEQ ID NO: 980 - RNA, 19 nt, Artificial Sequence
  Description of Artificial Sequence: Synthetic oligonucleotide
ccgccuggccgugcagcug

SEQ ID NO: 981 - RNA, 19 nt, Artificial Sequence
  Description of Artificial Sequence: Synthetic oligonucleotide
cgccuggccgugcagcugc

SEQ ID NO: 982 - RNA, 19 nt, Artificial Sequence
  Description of Artificial Sequence: Synthetic oligonucleotide
gccuggccgugcagcugcg

SEQ ID NO: 983 - RNA, 19 nt, Artificial Sequence
  Description of Artificial Sequence: Synthetic oligonucleotide
ccuggccgugcagcugcgg

SEQ ID NO: 984 - RNA, 19 nt, Artificial Sequence
  Description of Artificial Sequence: Synthetic oligonucleotide
cuggccgugcagcugcggg

SEQ ID NO: 985 - RNA, 19 nt, Artificial Sequence
  Description of Artificial Sequence: Synthetic oligonucleotide
uggccgugcagcugcggga

SEQ ID NO: 986 - RNA, 19 nt, Artificial Sequence
  Description of Artificial Sequence: Synthetic oligonucleotide
ggccgugcagcugcgggac

SEQ ID NO: 987 - RNA, 19 nt, Artificial Sequence
  Description of Artificial Sequence: Synthetic oligonucleotide
gccgugcagcugcgggacu

SEQ ID NO: 988 - RNA, 19 nt, Artificial Sequence
  Description of Artificial Sequence: Synthetic oligonucleotide
ccgugcagcugcgggacug

SEQ ID NO: 989 - RNA, 19 nt, Artificial Sequence
  Description of Artificial Sequence: Synthetic oligonucleotide
cgugcagcugcgggacugg

SEQ ID NO: 990 - RNA, 19 nt, Artificial Sequence
  Description of Artificial Sequence: Synthetic oligonucleotide
gugcagcugcgggacuggg

SEQ ID NO: 991 - RNA, 19 nt, Artificial Sequence
  Description of Artificial Sequence: Synthetic oligonucleotide
ugcagcugcgggacuggga

SEQ ID NO: 992 - RNA, 19 nt, Artificial Sequence
  Description of Artificial Sequence: Synthetic oligonucleotide
gcagcugcgggacugggau

SEQ ID NO: 993 - RNA, 19 nt, Artificial Sequence
  Description of Artificial Sequence: Synthetic oligonucleotide
cagcugcgggacugggaug

SEQ ID NO: 994 - RNA, 19 nt, Artificial Sequence
  Description of Artificial Sequence: Synthetic oligonucleotide
agcugcgggacugggaugg

SEQ ID NO: 995 - RNA, 19 nt, Artificial Sequence
  Description of Artificial Sequence: Synthetic oligonucleotide
gcugcgggacugggauggc

SEQ ID NO: 996 - RNA, 19 nt, Artificial Sequence
  Description of Artificial Sequence: Synthetic oligonucleotide
cugcgggacugggauggca

SEQ ID NO: 997 - RNA, 19 nt, Artificial Sequence
  Description of Artificial Sequence: Synthetic oligonucleotide
ugcgggacugggauggcaa

SEQ ID NO: 998 - RNA, 19 nt, Artificial Sequence
  Description of Artificial Sequence: Synthetic oligonucleotide
gcgggacugggauggcaac

SEQ ID NO: 999 - RNA, 19 nt, Artificial Sequence
  Description of Artificial Sequence: Synthetic oligonucleotide
cgggacugggauggcaacg

SEQ ID NO: 1000 - RNA, 19 nt, Artificial Sequence
  Description of Artificial Sequence: Synthetic oligonucleotide
gggacugggauggcaacgc

SEQ ID NO: 1001 - RNA, 19 nt, Artificial Sequence
  Description of Artificial Sequence: Synthetic oligonucleotide
ggacugggauggcaacgcc

SEQ ID NO: 1002 - RNA, 19 nt, Artificial Sequence
  Description of Artificial Sequence: Synthetic oligonucleotide
gacugggauggcaacgccg

SEQ ID NO: 1003 - RNA, 19 nt, Artificial Sequence
  Description of Artificial Sequence: Synthetic oligonucleotide
acugggauggcaacgccga

SEQ ID NO: 1004 - RNA, 19 nt, Artificial Sequence
  Description of Artificial Sequence: Synthetic oligonucleotide
cugggauggcaacgccgag

SEQ ID NO: 1005 - RNA, 19 nt, Artificial Sequence
  Description of Artificial Sequence: Synthetic oligonucleotide
ugggauggcaacgccgagu

SEQ ID NO: 1006 - RNA, 19 nt, Artificial Sequence
  Description of Artificial Sequence: Synthetic oligonucleotide
gggauggcaacgccgaguu

SEQ ID NO: 1007 - RNA, 19 nt, Artificial Sequence
  Description of Artificial Sequence: Synthetic oligonucleotide
ggauggcaacgccgaguug

SEQ ID NO: 1008 - RNA, 19 nt, Artificial Sequence
  Description of Artificial Sequence: Synthetic oligonucleotide
gauggcaacgccgaguugc

SEQ ID NO: 1009 - RNA, 19 nt, Artificial Sequence
  Description of Artificial Sequence: Synthetic oligonucleotide
auggcaacgccgaguugcu

SEQ ID NO: 1010 - RNA, 19 nt, Artificial Sequence
  Description of Artificial Sequence: Synthetic oligonucleotide
uggcaacgccgaguugcug

SEQ ID NO: 1011 - RNA, 19 nt, Artificial Sequence
  Description of Artificial Sequence: Synthetic oligonucleotide
ggcaacgccgaguugcugc

SEQ ID NO: 1012 - RNA, 19 nt, Artificial Sequence
  Description of Artificial Sequence: Synthetic oligonucleotide
gcaacgccgaguugcugca

SEQ ID NO: 1013 - RNA, 19 nt, Artificial Sequence
  Description of Artificial Sequence: Synthetic oligonucleotide
caacgccgaguugcugcag

SEQ ID NO: 1014 - RNA, 19 nt, Artificial Sequence
  Description of Artificial Sequence: Synthetic oligonucleotide
aacgccgaguugcugcagu

SEQ ID NO: 1015 - RNA, 19 nt, Artificial Sequence
  Description of Artificial Sequence: Synthetic oligonucleotide
acgccgaguugcugcaguu

SEQ ID NO: 1016 - RNA, 19 nt, Artificial Sequence
  Description of Artificial Sequence: Synthetic oligonucleotide
cgccgaguugcugcaguuc

SEQ ID NO: 1017 - RNA, 19 nt, Artificial Sequence
  Description of Artificial Sequence: Synthetic oligonucleotide
gccgaguugcugcaguucu

SEQ ID NO: 1018 - RNA, 19 nt, Artificial Sequence
  Description of Artificial Sequence: Synthetic oligonucleotide
ccgaguugcugcaguucuc

SEQ ID NO: 1019 - RNA, 19 nt, Artificial Sequence
  Description of Artificial Sequence: Synthetic oligonucleotide
cgaguugcugcaguucucc

SEQ ID NO: 1020 - RNA, 19 nt, Artificial Sequence
  Description of Artificial Sequence: Synthetic oligonucleotide
gaguugcugcaguucuccg

SEQ ID NO: 1021 - RNA, 19 nt, Artificial Sequence
  Description of Artificial Sequence: Synthetic oligonucleotide
aguugcugcaguucuccgu

SEQ ID NO: 1022 - RNA, 19 nt, Artificial Sequence
  Description of Artificial Sequence: Synthetic oligonucleotide
guugcugcaguucuccgug

SEQ ID NO: 1023 - RNA, 19 nt, Artificial Sequence
  Description of Artificial Sequence: Synthetic oligonucleotide
uugcugcaguucuccgugc

SEQ ID NO: 1024 - RNA, 19 nt, Artificial Sequence
  Description of Artificial Sequence: Synthetic oligonucleotide
ugcugcaguucuccgugca

SEQ ID NO: 1025 - RNA, 19 nt, Artificial Sequence
  Description of Artificial Sequence: Synthetic oligonucleotide
gcugcaguucuccgugcac

SEQ ID NO: 1026 - RNA, 19 nt, Artificial Sequence
  Description of Artificial Sequence: Synthetic oligonucleotide
cugcaguucuccgugcacc

SEQ ID NO: 1027 - RNA, 19 nt, Artificial Sequence
  Description of Artificial Sequence: Synthetic oligonucleotide
ugcaguucuccgugcaccu

SEQ ID NO: 1028 - RNA, 19 nt, Artificial Sequence
  Description of Artificial Sequence: Synthetic oligonucleotide
gcaguucuccgugcaccug

SEQ ID NO: 1029 - RNA, 19 nt, Artificial Sequence
  Description of Artificial Sequence: Synthetic oligonucleotide
caguucuccgugcaccugg

SEQ ID NO: 1030 - RNA, 19 nt, Artificial Sequence
  Description of Artificial Sequence: Synthetic oligonucleotide
aguucuccgugcaccuggg

SEQ ID NO: 1031 - RNA, 19 nt, Artificial Sequence
  Description of Artificial Sequence: Synthetic oligonucleotide
guucuccgugcaccugggu

SEQ ID NO: 1032 - RNA, 19 nt, Artificial Sequence
  Description of Artificial Sequence: Synthetic oligonucleotide
uucuccgugcaccugggug

SEQ ID NO: 1033 - RNA, 19 nt, Artificial Sequence
  Description of Artificial Sequence: Synthetic oligonucleotide
ucuccgugcaccugggugg

SEQ ID NO: 1034 - RNA, 19 nt, Artificial Sequence
  Description of Artificial Sequence: Synthetic oligonucleotide
cuccgugcaccuggguggc

SEQ ID NO: 1035 - RNA, 19 nt, Artificial Sequence
  Description of Artificial Sequence: Synthetic oligonucleotide
uccgugcaccuggguggcg

SEQ ID NO: 1036 - RNA, 19 nt, Artificial Sequence
  Description of Artificial Sequence: Synthetic oligonucleotide
ccgugcaccuggguggcga

SEQ ID NO: 1037 - RNA, 19 nt, Artificial Sequence
  Description of Artificial Sequence: Synthetic oligonucleotide
cgugcaccuggguggcgag

SEQ ID NO: 1038 - RNA, 19 nt, Artificial Sequence
  Description of Artificial Sequence: Synthetic oligonucleotide
gugcaccuggguggcgagg

SEQ ID NO: 1039 - RNA, 19 nt, Artificial Sequence
  Description of Artificial Sequence: Synthetic oligonucleotide
ugcaccuggguggcgagga

SEQ ID NO: 1040 - RNA, 19 nt, Artificial Sequence
  Description of Artificial Sequence: Synthetic oligonucleotide
gcaccuggguggcgaggac

SEQ ID NO: 1041 - RNA, 19 nt, Artificial Sequence
  Description of Artificial Sequence: Synthetic oligonucleotide
caccuggguggcgaggaca

SEQ ID NO: 1042 - RNA, 19 nt, Artificial Sequence
  Description of Artificial Sequence: Synthetic oligonucleotide
accuggguggcgaggacac

SEQ ID NO: 1043 - RNA, 19 nt, Artificial Sequence
  Description of Artificial Sequence: Synthetic oligonucleotide
ccuggguggcgaggacacg

SEQ ID NO: 1044 - RNA, 19 nt, Artificial Sequence
  Description of Artificial Sequence: Synthetic oligonucleotide
cuggguggcgaggacacgg

SEQ ID NO: 1045 - RNA, 19 nt, Artificial Sequence
  Description of Artificial Sequence: Synthetic oligonucleotide
uggguggcgaggacacggc

SEQ ID NO: 1046 - RNA, 19 nt, Artificial Sequence
  Description of Artificial Sequence: Synthetic oligonucleotide
ggguggcgaggacacggcc

SEQ ID NO: 1047 - RNA, 19 nt, Artificial Sequence
  Description of Artificial Sequence: Synthetic oligonucleotide
gguggcgaggacacggccu

SEQ ID NO: 1048 - RNA, 19 nt, Artificial Sequence
  Description of Artificial Sequence: Synthetic oligonucleotide
guggcgaggacacggccua

SEQ ID NO: 1049 - RNA, 19 nt, Artificial Sequence
  Description of Artificial Sequence: Synthetic oligonucleotide
uggcgaggacacggccuau

SEQ ID NO: 1050 - RNA, 19 nt, Artificial Sequence
  Description of Artificial Sequence: Synthetic oligonucleotide
ggcgaggacacggccuaua

SEQ ID NO: 1051 - RNA, 19 nt, Artificial Sequence
  Description of Artificial Sequence: Synthetic oligonucleotide
gcgaggacacggccuauag

SEQ ID NO: 1052 - RNA, 19 nt, Artificial Sequence
  Description of Artificial Sequence: Synthetic oligonucleotide
cgaggacacggccuauagc

SEQ ID NO: 1053 - RNA, 19 nt, Artificial Sequence
  Description of Artificial Sequence: Synthetic oligonucleotide
gaggacacggccuauagcc

SEQ ID NO: 1054 - RNA, 19 nt, Artificial Sequence
  Description of Artificial Sequence: Synthetic oligonucleotide
aggacacggccuauagccu

SEQ ID NO: 1055 - RNA, 19 nt, Artificial Sequence
  Description of Artificial Sequence: Synthetic oligonucleotide
ggacacggccuauagccug

SEQ ID NO: 1056 - RNA, 19 nt, Artificial Sequence
  Description of Artificial Sequence: Synthetic oligonucleotide
gacacggccuauagccugc

SEQ ID NO: 1057 - RNA, 19 nt, Artificial Sequence
  Description of Artificial Sequence: Synthetic oligonucleotide
acacggccuauagccugca

SEQ ID NO: 1058 - RNA, 19 nt, Artificial Sequence
  Description of Artificial Sequence: Synthetic oligonucleotide
cacggccuauagccugcag

SEQ ID NO: 1059 - RNA, 19 nt, Artificial Sequence
  Description of Artificial Sequence: Synthetic oligonucleotide
acggccuauagccugcagc

SEQ ID NO: 1060 - RNA, 19 nt, Artificial Sequence
  Description of Artificial Sequence: Synthetic oligonucleotide
cggccuauagccugcagcu

SEQ ID NO: 1061 - RNA, 19 nt, Artificial Sequence
  Description of Artificial Sequence: Synthetic oligonucleotide
ggccuauagccugcagcuc

SEQ ID NO: 1062 - RNA, 19 nt, Artificial Sequence
  Description of Artificial Sequence: Synthetic oligonucleotide
gccuauagccugcagcuca

SEQ ID NO: 1063 - RNA, 19 nt, Artificial Sequence
  Description of Artificial Sequence: Synthetic oligonucleotide
ccuauagccugcagcucac

SEQ ID NO: 1064 - RNA, 19 nt, Artificial Sequence
  Description of Artificial Sequence: Synthetic oligonucleotide
cuauagccugcagcucacu

SEQ ID NO: 1065 - RNA, 19 nt, Artificial Sequence
  Description of Artificial Sequence: Synthetic oligonucleotide
uauagccugcagcucacug

SEQ ID NO: 1066 - RNA, 19 nt, Artificial Sequence
  Description of Artificial Sequence: Synthetic oligonucleotide
auagccugcagcucacugc

SEQ ID NO: 1067 - RNA, 19 nt, Artificial Sequence
  Description of Artificial Sequence: Synthetic oligonucleotide
uagccugcagcucacugca

SEQ ID NO: 1068 - RNA, 19 nt, Artificial Sequence
  Description of Artificial Sequence: Synthetic oligonucleotide
agccugcagcucacugcac

SEQ ID NO: 1069 - RNA, 19 nt, Artificial Sequence
  Description of Artificial Sequence: Synthetic oligonucleotide
gccugcagcucacugcacc

SEQ ID NO: 1070 - RNA, 19 nt, Artificial Sequence
  Description of Artificial Sequence: Synthetic oligonucleotide
ccugcagcucacugcaccc

SEQ ID NO: 1071 - RNA, 19 nt, Artificial Sequence
  Description of Artificial Sequence: Synthetic oligonucleotide
cugcagcucacugcacccg

SEQ ID NO: 1072 - RNA, 19 nt, Artificial Sequence
  Description of Artificial Sequence: Synthetic oligonucleotide
ugcagcucacugcacccgu

SEQ ID NO: 1073 - RNA, 19 nt, Artificial Sequence
  Description of Artificial Sequence: Synthetic oligonucleotide
gcagcucacugcacccgug

SEQ ID NO: 1074 - RNA, 19 nt, Artificial Sequence
  Description of Artificial Sequence: Synthetic oligonucleotide
cagcucacugcacccgugg

SEQ ID NO: 1075 - RNA, 19 nt, Artificial Sequence
  Description of Artificial Sequence: Synthetic oligonucleotide
agcucacugcacccguggc

SEQ ID NO: 1076 - RNA, 19 nt, Artificial Sequence
  Description of Artificial Sequence: Synthetic oligonucleotide
gcucacugcacccguggcc

SEQ ID NO: 1077 - RNA, 19 nt, Artificial Sequence
  Description of Artificial Sequence: Synthetic oligonucleotide
cucacugcacccguggccg

SEQ ID NO: 1078 - RNA, 19 nt, Artificial Sequence
  Description of Artificial Sequence: Synthetic oligonucleotide
ucacugcacccguggccgg

SEQ ID NO: 1079 - RNA, 19 nt, Artificial Sequence
  Description of Artificial Sequence: Synthetic oligonucleotide
cacugcacccguggccggc

SEQ ID NO: 1080 - RNA, 19 nt, Artificial Sequence
  Description of Artificial Sequence: Synthetic oligonucleotide
acugcacccguggccggcc

SEQ ID NO: 1081 - RNA, 19 nt, Artificial Sequence
  Description of Artificial Sequence: Synthetic oligonucleotide
cugcacccguggccggcca

SEQ ID NO: 1082 - RNA, 19 nt, Artificial Sequence
  Description of Artificial Sequence: Synthetic oligonucleotide
ugcacccguggccggccag

SEQ ID NO: 1083 - RNA, 19 nt, Artificial Sequence
  Description of Artificial Sequence: Synthetic oligonucleotide
gcacccguggccggccagc

SEQ ID NO: 1084 - RNA, 19 nt, Artificial Sequence
  Description of Artificial Sequence: Synthetic oligonucleotide
cacccguggccggccagcu

SEQ ID NO: 1085 - RNA, 19 nt, Artificial Sequence
  Description of Artificial Sequence: Synthetic oligonucleotide
acccguggccggccagcug

SEQ ID NO: 1086 - RNA, 19 nt, Artificial Sequence
  Description of Artificial Sequence: Synthetic oligonucleotide
cccguggccggccagcugg

SEQ ID NO: 1087 - RNA, 19 nt, Artificial Sequence
  Description of Artificial Sequence: Synthetic oligonucleotide
ccguggccggccagcuggg

SEQ ID NO: 1088 - RNA, 19 nt, Artificial Sequence
  Description of Artificial Sequence: Synthetic oligonucleotide
cguggccggccagcugggc

SEQ ID NO: 1089 - RNA, 19 nt, Artificial Sequence
  Description of Artificial Sequence: Synthetic oligonucleotide
guggccggccagcugggcg

SEQ ID NO: 1090 - RNA, 19 nt, Artificial Sequence
  Description of Artificial Sequence: Synthetic oligonucleotide
uggccggccagcugggcgc

SEQ ID NO: 1091 - RNA, 19 nt, Artificial Sequence
  Description of Artificial Sequence: Synthetic oligonucleotide
ggccggccagcugggcgcc

SEQ ID NO: 1092 - RNA, 19 nt, Artificial Sequence
  Description of Artificial Sequence: Synthetic oligonucleotide
gccggccagcugggcgcca

SEQ ID NO: 1093 - RNA, 19 nt, Artificial Sequence
  Description of Artificial Sequence: Synthetic oligonucleotide
ccggccagcugggcgccac

SEQ ID NO: 1094 - RNA, 19 nt, Artificial Sequence
  Description of Artificial Sequence: Synthetic oligonucleotide
cggccagcugggcgccacc

SEQ ID NO: 1095 - RNA, 19 nt, Artificial Sequence
  Description of Artificial Sequence: Synthetic oligonucleotide
ggccagcugggcgccacca

SEQ ID NO: 1096 - RNA, 19 nt, Artificial Sequence
  Description of Artificial Sequence: Synthetic oligonucleotide
gccagcugggcgccaccac

SEQ ID NO: 1097 - RNA, 19 nt, Artificial Sequence
  Description of Artificial Sequence: Synthetic oligonucleotide
ccagcugggcgccaccacc

SEQ ID NO: 1098 - RNA, 19 nt, Artificial Sequence
  Description of Artificial Sequence: Synthetic oligonucleotide
cagcugggcgccaccaccg

SEQ ID NO: 1099 - RNA, 19 nt, Artificial Sequence
  Description of Artificial Sequence: Synthetic oligonucleotide
agcugggcgccaccaccgu

SEQ ID NO: 1100 - RNA, 19 nt, Artificial Sequence
  Description of Artificial Sequence: Synthetic oligonucleotide
gcugggcgccaccaccguc

SEQ ID NO: 1101 - RNA, 19 nt, Artificial Sequence
  Description of Artificial Sequence: Synthetic oligonucleotide
cugggcgccaccaccgucc

SEQ ID NO: 1102 - RNA, 19 nt, Artificial Sequence
  Description of Artificial Sequence: Synthetic oligonucleotide
ugggcgccaccaccguccc

SEQ ID NO: 1103 - RNA, 19 nt, Artificial Sequence
  Description of Artificial Sequence: Synthetic oligonucleotide
gggcgccaccaccguccca

SEQ ID NO: 1104 - RNA, 19 nt, Artificial Sequence
  Description of Artificial Sequence: Synthetic oligonucleotide
ggcgccaccaccgucccac

SEQ ID NO: 1105 - RNA, 19 nt, Artificial Sequence
  Description of Artificial Sequence: Synthetic oligonucleotide
gcgccaccaccgucccacc

SEQ ID NO: 1106 - RNA, 19 nt, Artificial Sequence
  Description of Artificial Sequence: Synthetic oligonucleotide
cgccaccaccgucccaccc

SEQ ID NO: 1107 - RNA, 19 nt, Artificial Sequence
  Description of Artificial Sequence: Synthetic oligonucleotide
gccaccaccgucccaccca

SEQ ID NO: 1108 - RNA, 19 nt, Artificial Sequence
  Description of Artificial Sequence: Synthetic oligonucleotide
ccaccaccgucccacccag

SEQ ID NO: 1109 - RNA, 19 nt, Artificial Sequence
  Description of Artificial Sequence: Synthetic oligonucleotide
caccaccgucccacccagc

SEQ ID NO: 1110 - RNA, 19 nt, Artificial Sequence
  Description of Artificial Sequence: Synthetic oligonucleotide
accaccgucccacccagcg

SEQ ID NO: 1111 - RNA, 19 nt, Artificial Sequence
  Description of Artificial Sequence: Synthetic oligonucleotide
ccaccgucccacccagcgg

SEQ ID NO: 1112 - RNA, 19 nt, Artificial Sequence
  Description of Artificial Sequence: Synthetic oligonucleotide
caccgucccacccagcggc

SEQ ID NO: 1113 - RNA, 19 nt, Artificial Sequence
  Description of Artificial Sequence: Synthetic oligonucleotide
accgucccacccagcggcc

SEQ ID NO: 1114 - RNA, 19 nt, Artificial Sequence
  Description of Artificial Sequence: Synthetic oligonucleotide
ccgucccacccagcggccu

SEQ ID NO: 1115 - RNA, 19 nt, Artificial Sequence
  Description of Artificial Sequence: Synthetic oligonucleotide
cgucccacccagcggccuc

SEQ ID NO: 1116 - RNA, 19 nt, Artificial Sequence
  Description of Artificial Sequence: Synthetic oligonucleotide
gucccacccagcggccucu

SEQ ID NO: 1117 - RNA, 19 nt, Artificial Sequence
  Description of Artificial Sequence: Synthetic oligonucleotide
ucccacccagcggccucuc

SEQ ID NO: 1118 - RNA, 19 nt, Artificial Sequence
  Description of Artificial Sequence: Synthetic oligonucleotide
cccacccagcggccucucc

SEQ ID NO: 1119 - RNA, 19 nt, Artificial Sequence
  Description of Artificial Sequence: Synthetic oligonucleotide
ccacccagcggccucuccg

SEQ ID NO: 1120 - RNA, 19 nt, Artificial Sequence
  Description of Artificial Sequence: Synthetic oligonucleotide
cacccagcggccucuccgu

SEQ ID NO: 1121 - RNA, 19 nt, Artificial Sequence
  Description of Artificial Sequence: Synthetic oligonucleotide
acccagcggccucuccgua

SEQ ID NO: 1122 - RNA, 19 nt, Artificial Sequence
  Description of Artificial Sequence: Synthetic oligonucleotide
cccagcggccucuccguac

SEQ ID NO: 1123 - RNA, 19 nt, Artificial Sequence
  Description of Artificial Sequence: Synthetic oligonucleotide
ccagcggccucuccguacc

SEQ ID NO: 1124 - RNA, 19 nt, Artificial Sequence
  Description of Artificial Sequence: Synthetic oligonucleotide
cagcggccucuccguaccc

SEQ ID NO: 1125 - RNA, 19 nt, Artificial Sequence
  Description of Artificial Sequence: Synthetic oligonucleotide
agcggccucuccguacccu

SEQ ID NO: 1126 - RNA, 19 nt, Artificial Sequence
  Description of Artificial Sequence: Synthetic oligonucleotide
gcggccucuccguacccuu

SEQ ID NO: 1127 - RNA, 19 nt, Artificial Sequence
  Description of Artificial Sequence: Synthetic oligonucleotide
cggccucuccguacccuuc

SEQ ID NO: 1128 - RNA, 19 nt, Artificial Sequence
  Description of Artificial Sequence: Synthetic oligonucleotide
ggccucuccguacccuucu

SEQ ID NO: 1129 - RNA, 19 nt, Artificial Sequence
  Description of Artificial Sequence: Synthetic oligonucleotide
gccucuccguacccuucuc

SEQ ID NO: 1130 - RNA, 19 nt, Artificial Sequence
  Description of Artificial Sequence: Synthetic oligonucleotide
ccucuccguacccuucucc

SEQ ID NO: 1131 - RNA, 19 nt, Artificial Sequence
  Description of Artificial Sequence: Synthetic oligonucleotide
cucuccguacccuucucca

SEQ ID NO: 1132 - RNA, 19 nt, Artificial Sequence
  Description of Artificial Sequence: Synthetic oligonucleotide
ucuccguacccuucuccac

SEQ ID NO: 1133 - RNA, 19 nt, Artificial Sequence
  Description of Artificial Sequence: Synthetic oligonucleotide
cuccguacccuucuccacu

SEQ ID NO: 1134 - RNA, 19 nt, Artificial Sequence
  Description of Artificial Sequence: Synthetic oligonucleotide
uccguacccuucuccacuu

SEQ ID NO: 1135 - RNA, 19 nt, Artificial Sequence
  Description of Artificial Sequence: Synthetic oligonucleotide
ccguacccuucuccacuug

SEQ ID NO: 1136 - RNA, 19 nt, Artificial Sequence
  Description of Artificial Sequence: Synthetic oligonucleotide
cguacccuucuccacuugg

SEQ ID NO: 1137 - RNA, 19 nt, Artificial Sequence
  Description of Artificial Sequence: Synthetic oligonucleotide
guacccuucuccacuuggg

SEQ ID NO: 1138 - RNA, 19 nt, Artificial Sequence
  Description of Artificial Sequence: Synthetic oligonucleotide
uacccuucuccacuuggga

SEQ ID NO: 1139 - RNA, 19 nt, Artificial Sequence
  Description of Artificial Sequence: Synthetic oligonucleotide
acccuucuccacuugggac

SEQ ID NO: 1140 - RNA, 19 nt, Artificial Sequence
  Description of Artificial Sequence: Synthetic oligonucleotide
cccuucuccacuugggacc

SEQ ID NO: 1141 - RNA, 19 nt, Artificial Sequence
  Description of Artificial Sequence: Synthetic oligonucleotide
ccuucuccacuugggacca

SEQ ID NO: 1142 - RNA, 19 nt, Artificial Sequence
  Description of Artificial Sequence: Synthetic oligonucleotide
cuucuccacuugggaccag

SEQ ID NO: 1143 - RNA, 19 nt, Artificial Sequence
  Description of Artificial Sequence: Synthetic oligonucleotide
uucuccacuugggaccagg

SEQ ID NO: 1144 - RNA, 19 nt, Artificial Sequence
  Description of Artificial Sequence: Synthetic oligonucleotide
ucuccacuugggaccagga

SEQ ID NO: 1145 - RNA, 19 nt, Artificial Sequence
  Description of Artificial Sequence: Synthetic oligonucleotide
cuccacuugggaccaggau

SEQ ID NO: 1146 - RNA, 19 nt, Artificial Sequence
  Description of Artificial Sequence: Synthetic oligonucleotide
uccacuugggaccaggauc

SEQ ID NO: 1147 - RNA, 19 nt, Artificial Sequence
  Description of Artificial Sequence: Synthetic oligonucleotide
ccacuugggaccaggauca

SEQ ID NO: 1148 - RNA, 19 nt, Artificial Sequence
  Description of Artificial Sequence: Synthetic oligonucleotide
cacuugggaccaggaucac

SEQ ID NO: 1149 - RNA, 19 nt, Artificial Sequence
  Description of Artificial Sequence: Synthetic oligonucleotide
acuugggaccaggaucacg

SEQ ID NO: 1150 - RNA, 19 nt, Artificial Sequence
  Description of Artificial Sequence: Synthetic oligonucleotide
cuugggaccaggaucacga

SEQ ID NO: 1151 - RNA, 19 nt, Artificial Sequence
  Description of Artificial Sequence: Synthetic oligonucleotide
uugggaccaggaucacgac

SEQ ID NO: 1152 - RNA, 19 nt, Artificial Sequence
  Description of Artificial Sequence: Synthetic oligonucleotide
ugggaccaggaucacgacc

SEQ ID NO: 1153 - RNA, 19 nt, Artificial Sequence
  Description of Artificial Sequence: Synthetic oligonucleotide
gggaccaggaucacgaccu

SEQ ID NO: 1154 - RNA, 19 nt, Artificial Sequence
  Description of Artificial Sequence: Synthetic oligonucleotide
ggaccaggaucacgaccuc

SEQ ID NO: 1155 - RNA, 19 nt, Artificial Sequence
  Description of Artificial Sequence: Synthetic oligonucleotide
gaccaggaucacgaccucc

SEQ ID NO: 1156 - RNA, 19 nt, Artificial Sequence
  Description of Artificial Sequence: Synthetic oligonucleotide
accaggaucacgaccuccg

SEQ ID NO: 1157 - RNA, 19 nt, Artificial Sequence
  Description of Artificial Sequence: Synthetic oligonucleotide
ccaggaucacgaccuccgc

SEQ ID NO: 1158 - RNA, 19 nt, Artificial Sequence
  Description of Artificial Sequence: Synthetic oligonucleotide
caggaucacgaccuccgca

SEQ ID NO: 1159 - RNA, 19 nt, Artificial Sequence
  Description of Artificial Sequence: Synthetic oligonucleotide
aggaucacgaccuccgcag

SEQ ID NO: 1160 - RNA, 19 nt, Artificial Sequence
  Description of Artificial Sequence: Synthetic oligonucleotide
ggaucacgaccuccgcagg

SEQ ID NO: 1161 - RNA, 19 nt, Artificial Sequence
  Description of Artificial Sequence: Synthetic oligonucleotide
gaucacgaccuccgcaggg

SEQ ID NO: 1162 - RNA, 19 nt, Artificial Sequence
  Description of Artificial Sequence: Synthetic oligonucleotide
aucacgaccuccgcaggga

SEQ ID NO: 1163 - RNA, 19 nt, Artificial Sequence
  Description of Artificial Sequence: Synthetic oligonucleotide
ucacgaccuccgcagggac

SEQ ID NO: 1164 - RNA, 19 nt, Artificial Sequence
  Description of Artificial Sequence: Synthetic oligonucleotide
cacgaccuccgcagggaca

SEQ ID NO: 1165 - RNA, 19 nt, Artificial Sequence
  Description of Artificial Sequence: Synthetic oligonucleotide
acgaccuccgcagggacaa

SEQ ID NO: 1166 - RNA, 19 nt, Artificial Sequence
  Description of Artificial Sequence: Synthetic oligonucleotide
cgaccuccgcagggacaag

SEQ ID NO: 1167 - RNA, 19 nt, Artificial Sequence
  Description of Artificial Sequence: Synthetic oligonucleotide
gaccuccgcagggacaaga

SEQ ID NO: 1168 - RNA, 19 nt, Artificial Sequence
  Description of Artificial Sequence: Synthetic oligonucleotide
accuccgcagggacaagaa

SEQ ID NO: 1169 - RNA, 19 nt, Artificial Sequence
  Description of Artificial Sequence: Synthetic oligonucleotide
ccuccgcagggacaagaac

SEQ ID NO: 1170 - RNA, 19 nt, Artificial Sequence
  Description of Artificial Sequence: Synthetic oligonucleotide
cuccgcagggacaagaacu

SEQ ID NO: 1171 - RNA, 19 nt, Artificial Sequence
  Description of Artificial Sequence: Synthetic oligonucleotide
uccgcagggacaagaacug

SEQ ID NO: 1172 - RNA, 19 nt, Artificial Sequence
  Description of Artificial Sequence: Synthetic oligonucleotide
ccgcagggacaagaacugc

SEQ ID NO: 1173 - RNA, 19 nt, Artificial Sequence
  Description of Artificial Sequence: Synthetic oligonucleotide
cgcagggacaagaacugcg

SEQ ID NO: 1174 - RNA, 19 nt, Artificial Sequence
  Description of Artificial Sequence: Synthetic oligonucleotide
gcagggacaagaacugcgc

SEQ ID NO: 1175 - RNA, 19 nt, Artificial Sequence
  Description of Artificial Sequence: Synthetic oligonucleotide
cagggacaagaacugcgcc

SEQ ID NO: 1176 - RNA, 19 nt, Artificial Sequence
  Description of Artificial Sequence: Synthetic oligonucleotide
agggacaagaacugcgcca

SEQ ID NO: 1177 - RNA, 19 nt, Artificial Sequence
  Description of Artificial Sequence: Synthetic oligonucleotide
gggacaagaacugcgccaa

SEQ ID NO: 1178 - RNA, 19 nt, Artificial Sequence
  Description of Artificial Sequence: Synthetic oligonucleotide
ggacaagaacugcgccaag

SEQ ID NO: 1179 - RNA, 19 nt, Artificial Sequence
  Description of Artificial Sequence: Synthetic oligonucleotide
gacaagaacugcgccaaga

SEQ ID NO: 1180 - RNA, 19 nt, Artificial Sequence
  Description of Artificial Sequence: Synthetic oligonucleotide
acaagaacugcgccaagag

SEQ ID NO: 1181 - RNA, 19 nt, Artificial Sequence
  Description of Artificial Sequence: Synthetic oligonucleotide
caagaacugcgccaagagc

SEQ ID NO: 1182 - RNA, 19 nt, Artificial Sequence
  Description of Artificial Sequence: Synthetic oligonucleotide
aagaacugcgccaagagcc

SEQ ID NO: 1183 - RNA, 19 nt, Artificial Sequence
  Description of Artificial Sequence: Synthetic oligonucleotide
agaacugcgccaagagccu

SEQ ID NO: 1184 - RNA, 19 nt, Artificial Sequence
  Description of Artificial Sequence: Synthetic oligonucleotide
gaacugcgccaagagccuc

SEQ ID NO: 1185 - RNA, 19 nt, Artificial Sequence
  Description of Artificial Sequence: Synthetic oligonucleotide
aacugcgccaagagccucu

SEQ ID NO: 1186 - RNA, 19 nt, Artificial Sequence
  Description of Artificial Sequence: Synthetic oligonucleotide
acugcgccaagagccucuc

SEQ ID NO: 1187 - RNA, 19 nt, Artificial Sequence
  Description of Artificial Sequence: Synthetic oligonucleotide
cugcgccaagagccucucu

SEQ ID NO: 1188 - RNA, 19 nt, Artificial Sequence
  Description of Artificial Sequence: Synthetic oligonucleotide
ugcgccaagagccucucug

SEQ ID NO: 1189 - RNA, 19 nt, Artificial Sequence
  Description of Artificial Sequence: Synthetic oligonucleotide
gcgccaagagccucucugg

SEQ ID NO: 1190 - RNA, 19 nt, Artificial Sequence
  Description of Artificial Sequence: Synthetic oligonucleotide
cgccaagagccucucugga

SEQ ID NO: 1191 - RNA, 19 nt, Artificial Sequence
  Description of Artificial Sequence: Synthetic oligonucleotide
gccaagagccucucuggag

SEQ ID NO: 1192 - RNA, 19 nt, Artificial Sequence
  Description of Artificial Sequence: Synthetic oligonucleotide
ccaagagccucucuggagg

SEQ ID NO: 1193 - RNA, 19 nt, Artificial Sequence
  Description of Artificial Sequence: Synthetic oligonucleotide
caagagccucucuggaggc

SEQ ID NO: 1194 - RNA, 19 nt, Artificial Sequence
  Description of Artificial Sequence: Synthetic oligonucleotide
aagagccucucuggaggcu

SEQ ID NO: 1195 - RNA, 19 nt, Artificial Sequence
  Description of Artificial Sequence: Synthetic oligonucleotide
agagccucucuggaggcug

SEQ ID NO: 1196 - RNA, 19 nt, Artificial Sequence
  Description of Artificial Sequence: Synthetic oligonucleotide
gagccucucuggaggcugg

SEQ ID NO: 1197 - RNA, 19 nt, Artificial Sequence
  Description of Artificial Sequence: Synthetic oligonucleotide
agccucucuggaggcuggu

SEQ ID NO: 1198 - RNA, 19 nt, Artificial Sequence
  Description of Artificial Sequence: Synthetic oligonucleotide
gccucucuggaggcuggug

SEQ ID NO: 1199 - RNA, 19 nt, Artificial Sequence
  Description of Artificial Sequence: Synthetic oligonucleotide
ccucucuggaggcuggugg

SEQ ID NO: 1200 - RNA, 19 nt, Artificial Sequence
  Description of Artificial Sequence: Synthetic oligonucleotide
cucucuggaggcugguggu

SEQ ID NO: 1201 - RNA, 19 nt, Artificial Sequence
  Description of Artificial Sequence: Synthetic oligonucleotide
ucucuggaggcuggugguu

SEQ ID NO: 1202 - RNA, 19 nt, Artificial Sequence
  Description of Artificial Sequence: Synthetic oligonucleotide
cucuggaggcuggugguuu

SEQ ID NO: 1203 - RNA, 19 nt, Artificial Sequence
  Description of Artificial Sequence: Synthetic oligonucleotide
ucuggaggcuggugguuug

SEQ ID NO: 1204 - RNA, 19 nt, Artificial Sequence
  Description of Artificial Sequence: Synthetic oligonucleotide
cuggaggcuggugguuugg

SEQ ID NO: 1205 - RNA, 19 nt, Artificial Sequence
  Description of Artificial Sequence: Synthetic oligonucleotide
uggaggcuggugguuuggc

SEQ ID NO: 1206 - RNA, 19 nt, Artificial Sequence
  Description of Artificial Sequence: Synthetic oligonucleotide
ggaggcuggugguuuggca

SEQ ID NO: 1207 - RNA, 19 nt, Artificial Sequence
  Description of Artificial Sequence: Synthetic oligonucleotide
gaggcuggugguuuggcac

SEQ ID NO: 1208 - RNA, 19 nt, Artificial Sequence
  Description of Artificial Sequence: Synthetic oligonucleotide
aggcuggugguuuggcacc

SEQ ID NO: 1209 - RNA, 19 nt, Artificial Sequence
  Description of Artificial Sequence: Synthetic oligonucleotide
ggcuggugguuuggcaccu

SEQ ID NO: 1210 - RNA, 19 nt, Artificial Sequence
  Description of Artificial Sequence: Synthetic oligonucleotide
gcuggugguuuggcaccug

SEQ ID NO: 1211 - RNA, 19 nt, Artificial Sequence
  Description of Artificial Sequence: Synthetic oligonucleotide
cuggugguuuggcaccugc

SEQ ID NO: 1212 - RNA, 19 nt, Artificial Sequence
  Description of Artificial Sequence: Synthetic oligonucleotide
uggugguuuggcaccugca

SEQ ID NO: 1213 - RNA, 19 nt, Artificial Sequence
  Description of Artificial Sequence: Synthetic oligonucleotide
ggugguuuggcaccugcag

SEQ ID NO: 1214 - RNA, 19 nt, Artificial Sequence
  Description of Artificial Sequence: Synthetic oligonucleotide
gugguuuggcaccugcagc

SEQ ID NO: 1215 - RNA, 19 nt, Artificial Sequence
  Description of Artificial Sequence: Synthetic oligonucleotide
ugguuuggcaccugcagcc

SEQ ID NO: 1216 - RNA, 19 nt, Artificial Sequence
  Description of Artificial Sequence: Synthetic oligonucleotide
gguuuggcaccugcagcca

SEQ ID NO: 1217 - RNA, 19 nt, Artificial Sequence
  Description of Artificial Sequence: Synthetic oligonucleotide
guuuggcaccugcagccau

SEQ ID NO: 1218 - RNA, 19 nt, Artificial Sequence
  Description of Artificial Sequence: Synthetic oligonucleotide
uuuggcaccugcagccauu

SEQ ID NO: 1219 - RNA, 19 nt, Artificial Sequence
  Description of Artificial Sequence: Synthetic oligonucleotide
uuggcaccugcagccauuc

SEQ ID NO: 1220 - RNA, 19 nt, Artificial Sequence
  Description of Artificial Sequence: Synthetic oligonucleotide
uggcaccugcagccauucc

SEQ ID NO: 1221 - RNA, 19 nt, Artificial Sequence
  Description of Artificial Sequence: Synthetic oligonucleotide
ggcaccugcagccauucca

SEQ ID NO: 1222 - RNA, 19 nt, Artificial Sequence
  Description of Artificial Sequence: Synthetic oligonucleotide
gcaccugcagccauuccaa

SEQ ID NO: 1223 - RNA, 19 nt, Artificial Sequence
  Description of Artificial Sequence: Synthetic oligonucleotide
caccugcagccauuccaac

SEQ ID NO: 1224 - RNA, 19 nt, Artificial Sequence
  Description of Artificial Sequence: Synthetic oligonucleotide
accugcagccauuccaacc

SEQ ID NO: 1225 - RNA, 19 nt, Artificial Sequence
  Description of Artificial Sequence: Synthetic oligonucleotide
ccugcagccauuccaaccu

SEQ ID NO: 1226 - RNA, 19 nt, Artificial Sequence
  Description of Artificial Sequence: Synthetic oligonucleotide
cugcagccauuccaaccuc

SEQ ID NO: 1227 - RNA, 19 nt, Artificial Sequence
  Description of Artificial Sequence: Synthetic oligonucleotide
ugcagccauuccaaccuca

SEQ ID NO: 1228 - RNA, 19 nt, Artificial Sequence
  Description of Artificial Sequence: Synthetic oligonucleotide
gcagccauuccaaccucaa

SEQ ID NO: 1229 - RNA, 19 nt, Artificial Sequence
  Description of Artificial Sequence: Synthetic oligonucleotide
cagccauuccaaccucaac

SEQ ID NO: 1230 - RNA, 19 nt, Artificial Sequence
  Description of Artificial Sequence: Synthetic oligonucleotide
agccauuccaaccucaacg

SEQ ID NO: 1231 - RNA, 19 nt, Artificial Sequence
  Description of Artificial Sequence: Synthetic oligonucleotide
gccauuccaaccucaacgg

SEQ ID NO: 1232 - RNA, 19 nt, Artificial Sequence
  Description of Artificial Sequence: Synthetic oligonucleotide
ccauuccaaccucaacggc

SEQ ID NO: 1233 - RNA, 19 nt, Artificial Sequence
  Description of Artificial Sequence: Synthetic oligonucleotide
cauuccaaccucaacggcc

SEQ ID NO: 1234 - RNA, 19 nt, Artificial Sequence
  Description of Artificial Sequence: Synthetic oligonucleotide
auuccaaccucaacggcca

SEQ ID NO: 1235 - RNA, 19 nt, Artificial Sequence
  Description of Artificial Sequence: Synthetic oligonucleotide
uuccaaccucaacggccag

SEQ ID NO: 1236 - RNA, 19 nt, Artificial Sequence
  Description of Artificial Sequence: Synthetic oligonucleotide
uccaaccucaacggccagu

SEQ ID NO: 1237 - RNA, 19 nt, Artificial Sequence
  Description of Artificial Sequence: Synthetic oligonucleotide
ccaaccucaacggccagua

SEQ ID NO: 1238 - RNA, 19 nt, Artificial Sequence
  Description of Artificial Sequence: Synthetic oligonucleotide
caaccucaacggccaguac

SEQ ID NO: 1239 - RNA, 19 nt, Artificial Sequence
  Description of Artificial Sequence: Synthetic oligonucleotide
aaccucaacggccaguacu

SEQ ID NO: 1240 - RNA, 19 nt, Artificial Sequence
  Description of Artificial Sequence: Synthetic oligonucleotide
accucaacggccaguacuu

SEQ ID NO: 1241 - RNA, 19 nt, Artificial Sequence
  Description of Artificial Sequence: Synthetic oligonucleotide
ccucaacggccaguacuuc

SEQ ID NO: 1242 - RNA, 19 nt, Artificial Sequence
  Description of Artificial Sequence: Synthetic oligonucleotide
cucaacggccaguacuucc

SEQ ID NO: 1243 - RNA, 19 nt, Artificial Sequence
  Description of Artificial Sequence: Synthetic oligonucleotide
ucaacggccaguacuuccg

SEQ ID NO: 1244 - RNA, 19 nt, Artificial Sequence
  Description of Artificial Sequence: Synthetic oligonucleotide
caacggccaguacuuccgc

SEQ ID NO: 1245 - RNA, 19 nt, Artificial Sequence
  Description of Artificial Sequence: Synthetic oligonucleotide
aacggccaguacuuccgcu

SEQ ID NO: 1246 - RNA, 19 nt, Artificial Sequence
  Description of Artificial Sequence: Synthetic oligonucleotide
acggccaguacuuccgcuc

SEQ ID NO: 1247 - RNA, 19 nt, Artificial Sequence
  Description of Artificial Sequence: Synthetic oligonucleotide
cggccaguacuuccgcucc

SEQ ID NO: 1248 - RNA, 19 nt, Artificial Sequence
  Description of Artificial Sequence: Synthetic oligonucleotide
ggccaguacuuccgcucca

SEQ ID NO: 1249 - RNA, 19 nt, Artificial Sequence
  Description of Artificial Sequence: Synthetic oligonucleotide
gccaguacuuccgcuccau

SEQ ID NO: 1250 - RNA, 19 nt, Artificial Sequence
  Description of Artificial Sequence: Synthetic oligonucleotide
ccaguacuuccgcuccauc

SEQ ID NO: 1251 - RNA, 19 nt, Artificial Sequence
  Description of Artificial Sequence: Synthetic oligonucleotide
caguacuuccgcuccaucc

SEQ ID NO: 1252 - RNA, 19 nt, Artificial Sequence
  Description of Artificial Sequence: Synthetic oligonucleotide
aguacuuccgcuccauccc

SEQ ID NO: 1253 - RNA, 19 nt, Artificial Sequence
  Description of Artificial Sequence: Synthetic oligonucleotide
guacuuccgcuccauccca

SEQ ID NO: 1254 - RNA, 19 nt, Artificial Sequence
  Description of Artificial Sequence: Synthetic oligonucleotide
uacuuccgcuccaucccac

SEQ ID NO: 1255 - RNA, 19 nt, Artificial Sequence
  Description of Artificial Sequence: Synthetic oligonucleotide
acuuccgcuccaucccaca

SEQ ID NO: 1256 - RNA, 19 nt, Artificial Sequence
  Description of Artificial Sequence: Synthetic oligonucleotide
cuuccgcuccaucccacag

SEQ ID NO: 1257 - RNA, 19 nt, Artificial Sequence
  Description of Artificial Sequence: Synthetic oligonucleotide
uuccgcuccaucccacagc

SEQ ID NO: 1258 - RNA, 19 nt, Artificial Sequence
  Description of Artificial Sequence: Synthetic oligonucleotide
uccgcuccaucccacagca

SEQ ID NO: 1259 - RNA, 19 nt, Artificial Sequence
  Description of Artificial Sequence: Synthetic oligonucleotide
ccgcuccaucccacagcag

SEQ ID NO: 1260 - RNA, 19 nt, Artificial Sequence
  Description of Artificial Sequence: Synthetic oligonucleotide
cgcuccaucccacagcagc

SEQ ID NO: 1261 - RNA, 19 nt, Artificial Sequence
  Description of Artificial Sequence: Synthetic oligonucleotide
gcuccaucccacagcagcg

SEQ ID NO: 1262 - RNA, 19 nt, Artificial Sequence
  Description of Artificial Sequence: Synthetic oligonucleotide
cuccaucccacagcagcgg

SEQ ID NO: 1263 - RNA, 19 nt, Artificial Sequence
  Description of Artificial Sequence: Synthetic oligonucleotide
uccaucccacagcagcggc

SEQ ID NO: 1264 - RNA, 19 nt, Artificial Sequence
  Description of Artificial Sequence: Synthetic oligonucleotide
ccaucccacagcagcggca

SEQ ID NO: 1265 - RNA, 19 nt, Artificial Sequence
  Description of Artificial Sequence: Synthetic oligonucleotide
caucccacagcagcggcag

SEQ ID NO: 1266 - RNA, 19 nt, Artificial Sequence
  Description of Artificial Sequence: Synthetic oligonucleotide
aucccacagcagcggcaga

SEQ ID NO: 1267 - RNA, 19 nt, Artificial Sequence
  Description of Artificial Sequence: Synthetic oligonucleotide
ucccacagcagcggcagaa

SEQ ID NO: 1268 - RNA, 19 nt, Artificial Sequence
  Description of Artificial Sequence: Synthetic oligonucleotide
cccacagcagcggcagaag

SEQ ID NO: 1269 - RNA, 19 nt, Artificial Sequence
  Description of Artificial Sequence: Synthetic oligonucleotide
ccacagcagcggcagaagc

SEQ ID NO: 1270 - RNA, 19 nt, Artificial Sequence
  Description of Artificial Sequence: Synthetic oligonucleotide
cacagcagcggcagaagcu

SEQ ID NO: 1271 - RNA, 19 nt, Artificial Sequence
  Description of Artificial Sequence: Synthetic oligonucleotide
acagcagcggcagaagcuu

SEQ ID NO: 1272 - RNA, 19 nt, Artificial Sequence
  Description of Artificial Sequence: Synthetic oligonucleotide
cagcagcggcagaagcuua

SEQ ID NO: 1273 - RNA, 19 nt, Artificial Sequence
  Description of Artificial Sequence: Synthetic oligonucleotide
agcagcggcagaagcuuaa

SEQ ID NO: 1274 - RNA, 19 nt, Artificial Sequence
  Description of Artificial Sequence: Synthetic oligonucleotide
gcagcggcagaagcuuaag

SEQ ID NO: 1275 - RNA, 19 nt, Artificial Sequence
  Description of Artificial Sequence: Synthetic oligonucleotide
cagcggcagaagcuuaaga

SEQ ID NO: 1276 - RNA, 19 nt, Artificial Sequence
  Description of Artificial Sequence: Synthetic oligonucleotide
agcggcagaagcuuaagaa

SEQ ID NO: 1277 - RNA, 19 nt, Artificial Sequence
  Description of Artificial Sequence: Synthetic oligonucleotide
gcggcagaagcuuaagaag

SEQ ID NO: 1278 - RNA, 19 nt, Artificial Sequence
  Description of Artificial Sequence: Synthetic oligonucleotide
cggcagaagcuuaagaagg

SEQ ID NO: 1279 - RNA, 19 nt, Artificial Sequence
  Description of Artificial Sequence: Synthetic oligonucleotide
ggcagaagcuuaagaaggg

SEQ ID NO: 1280 - RNA, 19 nt, Artificial Sequence
  Description of Artificial Sequence: Synthetic oligonucleotide
gcagaagcuuaagaaggga

SEQ ID NO: 1281 - RNA, 19 nt, Artificial Sequence
  Description of Artificial Sequence: Synthetic oligonucleotide
cagaagcuuaagaagggaa

SEQ ID NO: 1282 - RNA, 19 nt, Artificial Sequence
  Description of Artificial Sequence: Synthetic oligonucleotide
agaagcuuaagaagggaau

SEQ ID NO: 1283 - RNA, 19 nt, Artificial Sequence
  Description of Artificial Sequence: Synthetic oligonucleotide
gaagcuuaagaagggaauc

SEQ ID NO: 1284 - RNA, 19 nt, Artificial Sequence
  Description of Artificial Sequence: Synthetic oligonucleotide
aagcuuaagaagggaaucu

SEQ ID NO: 1285 - RNA, 19 nt, Artificial Sequence
  Description of Artificial Sequence: Synthetic oligonucleotide
agcuuaagaagggaaucuu

SEQ ID NO: 1286 - RNA, 19 nt, Artificial Sequence
  Description of Artificial Sequence: Synthetic oligonucleotide
gcuuaagaagggaaucuuc

SEQ ID NO: 1287 - RNA, 19 nt, Artificial Sequence
  Description of Artificial Sequence: Synthetic oligonucleotide
cuuaagaagggaaucuucu

SEQ ID NO: 1288 - RNA, 19 nt, Artificial Sequence
  Description of Artificial Sequence: Synthetic oligonucleotide
uuaagaagggaaucuucug

SEQ ID NO: 1289 - RNA, 19 nt, Artificial Sequence
  Description of Artificial Sequence: Synthetic oligonucleotide
uaagaagggaaucuucugg

SEQ ID NO: 1290 - RNA, 19 nt, Artificial Sequence
  Description of Artificial Sequence: Synthetic oligonucleotide
aagaagggaaucuucugga

SEQ ID NO: 1291 - RNA, 19 nt, Artificial Sequence
  Description of Artificial Sequence: Synthetic oligonucleotide
agaagggaaucuucuggaa

SEQ ID NO: 1292 - RNA, 19 nt, Artificial Sequence
  Description of Artificial Sequence: Synthetic oligonucleotide
gaagggaaucuucuggaag

SEQ ID NO: 1293 - RNA, 19 nt, Artificial Sequence
  Description of Artificial Sequence: Synthetic oligonucleotide
aagggaaucuucuggaaga

SEQ ID NO: 1294 - RNA, 19 nt, Artificial Sequence
  Description of Artificial Sequence: Synthetic oligonucleotide
agggaaucuucuggaagac

SEQ ID NO: 1295 - RNA, 19 nt, Artificial Sequence
  Description of Artificial Sequence: Synthetic oligonucleotide
gggaaucuucuggaagacc

SEQ ID NO: 1296 - RNA, 19 nt, Artificial Sequence
  Description of Artificial Sequence: Synthetic oligonucleotide
ggaaucuucuggaagaccu

SEQ ID NO: 1297 - RNA, 19 nt, Artificial Sequence
  Description of Artificial Sequence: Synthetic oligonucleotide
gaaucuucuggaagaccug

SEQ ID NO: 1298 - RNA, 19 nt, Artificial Sequence
  Description of Artificial Sequence: Synthetic oligonucleotide
aaucuucuggaagaccugg

SEQ ID NO: 1299 - RNA, 19 nt, Artificial Sequence
  Description of Artificial Sequence: Synthetic oligonucleotide
aucuucuggaagaccuggc

SEQ ID NO: 1300 - RNA, 19 nt, Artificial Sequence
  Description of Artificial Sequence: Synthetic oligonucleotide
ucuucuggaagaccuggcg

SEQ ID NO: 1301 - RNA, 19 nt, Artificial Sequence
  Description of Artificial Sequence: Synthetic oligonucleotide
cuucuggaagaccuggcgg

SEQ ID NO: 1302 - RNA, 19 nt, Artificial Sequence
  Description of Artificial Sequence: Synthetic oligonucleotide
uucuggaagaccuggcggg

SEQ ID NO: 1303 - RNA, 19 nt, Artificial Sequence
  Description of Artificial Sequence: Synthetic oligonucleotide
ucuggaagaccuggcgggg

SEQ ID NO: 1304 - RNA, 19 nt, Artificial Sequence
  Description of Artificial Sequence: Synthetic oligonucleotide
cuggaagaccuggcggggc

SEQ ID NO: 1305 - RNA, 19 nt, Artificial Sequence
  Description of Artificial Sequence: Synthetic oligonucleotide
uggaagaccuggcggggcc

SEQ ID NO: 1306 - RNA, 19 nt, Artificial Sequence
  Description of Artificial Sequence: Synthetic oligonucleotide
ggaagaccuggcggggccg

SEQ ID NO: 1307 - RNA, 19 nt, Artificial Sequence
  Description of Artificial Sequence: Synthetic oligonucleotide
gaagaccuggcggggccgc

SEQ ID NO: 1308 - RNA, 19 nt, Artificial Sequence
  Description of Artificial Sequence: Synthetic oligonucleotide
aagaccuggcggggccgcu

SEQ ID NO: 1309 - RNA, 19 nt, Artificial Sequence
  Description of Artificial Sequence: Synthetic oligonucleotide
agaccuggcggggccgcua

SEQ ID NO: 1310 - RNA, 19 nt, Artificial Sequence
  Description of Artificial Sequence: Synthetic oligonucleotide
gaccuggcggggccgcuac

SEQ ID NO: 1311 - RNA, 19 nt, Artificial Sequence
  Description of Artificial Sequence: Synthetic oligonucleotide
accuggcggggccgcuacu

SEQ ID NO: 1312 - RNA, 19 nt, Artificial Sequence
  Description of Artificial Sequence: Synthetic oligonucleotide
ccuggcggggccgcuacua

SEQ ID NO: 1313 - RNA, 19 nt, Artificial Sequence
  Description of Artificial Sequence: Synthetic oligonucleotide
cuggcggggccgcuacuac

SEQ ID NO: 1314 - RNA, 19 nt, Artificial Sequence
  Description of Artificial Sequence: Synthetic oligonucleotide
uggcggggccgcuacuacc

SEQ ID NO: 1315 - RNA, 19 nt, Artificial Sequence
  Description of Artificial Sequence: Synthetic oligonucleotide
ggcggggccgcuacuaccc

SEQ ID NO: 1316 - RNA, 19 nt, Artificial Sequence
  Description of Artificial Sequence: Synthetic oligonucleotide
gcggggccgcuacuacccg

SEQ ID NO: 1317 - RNA, 19 nt, Artificial Sequence
  Description of Artificial Sequence: Synthetic oligonucleotide
cggggccgcuacuacccgc

SEQ ID NO: 1318 - RNA, 19 nt, Artificial Sequence
  Description of Artificial Sequence: Synthetic oligonucleotide
ggggccgcuacuacccgcu

SEQ ID NO: 1319 - RNA, 19 nt, Artificial Sequence
  Description of Artificial Sequence: Synthetic oligonucleotide
gggccgcuacuacccgcug

SEQ ID NO: 1320 - RNA, 19 nt, Artificial Sequence
  Description of Artificial Sequence: Synthetic oligonucleotide
ggccgcuacuacccgcugc

SEQ ID NO: 1321 - RNA, 19 nt, Artificial Sequence
  Description of Artificial Sequence: Synthetic oligonucleotide
gccgcuacuacccgcugca

SEQ ID NO: 1322 - RNA, 19 nt, Artificial Sequence
  Description of Artificial Sequence: Synthetic oligonucleotide
ccgcuacuacccgcugcag

SEQ ID NO: 1323 - RNA, 19 nt, Artificial Sequence
  Description of Artificial Sequence: Synthetic oligonucleotide
cgcuacuacccgcugcagg

SEQ ID NO: 1324 - RNA, 19 nt, Artificial Sequence
  Description of Artificial Sequence: Synthetic oligonucleotide
gcuacuacccgcugcaggc

SEQ ID NO: 1325 - RNA, 19 nt, Artificial Sequence
  Description of Artificial Sequence: Synthetic oligonucleotide
cuacuacccgcugcaggcc

SEQ ID NO: 1326 - RNA, 19 nt, Artificial Sequence
  Description of Artificial Sequence: Synthetic oligonucleotide
uacuacccgcugcaggcca

SEQ ID NO: 1327 - RNA, 19 nt, Artificial Sequence
  Description of Artificial Sequence: Synthetic oligonucleotide
acuacccgcugcaggccac

SEQ ID NO: 1328 - RNA, 19 nt, Artificial Sequence
  Description of Artificial Sequence: Synthetic oligonucleotide
cuacccgcugcaggccacc

SEQ ID NO: 1329 - RNA, 19 nt, Artificial Sequence
  Description of Artificial Sequence: Synthetic oligonucleotide
uacccgcugcaggccacca

SEQ ID NO: 1330 - RNA, 19 nt, Artificial Sequence
  Description of Artificial Sequence: Synthetic oligonucleotide
acccgcugcaggccaccac

SEQ ID NO: 1331 - RNA, 19 nt, Artificial Sequence
  Description of Artificial Sequence: Synthetic oligonucleotide
cccgcugcaggccaccacc

SEQ ID NO: 1332 - RNA, 19 nt, Artificial Sequence
  Description of Artificial Sequence: Synthetic oligonucleotide
ccgcugcaggccaccacca

SEQ ID NO: 1333 - RNA, 19 nt, Artificial Sequence
  Description of Artificial Sequence: Synthetic oligonucleotide
cgcugcaggccaccaccau

SEQ ID NO: 1334 - RNA, 19 nt, Artificial Sequence
  Description of Artificial Sequence: Synthetic oligonucleotide
gcugcaggccaccaccaug

SEQ ID NO: 1335 - RNA, 19 nt, Artificial Sequence
  Description of Artificial Sequence: Synthetic oligonucleotide
cugcaggccaccaccaugu

SEQ ID NO: 1336 - RNA, 19 nt, Artificial Sequence
  Description of Artificial Sequence: Synthetic oligonucleotide
ugcaggccaccaccauguu

SEQ ID NO: 1337 - RNA, 19 nt, Artificial Sequence
  Description of Artificial Sequence: Synthetic oligonucleotide
gcaggccaccaccauguug

SEQ ID NO: 1338 - RNA, 19 nt, Artificial Sequence
  Description of Artificial Sequence: Synthetic oligonucleotide
caggccaccaccauguuga

SEQ ID NO: 1339 - RNA, 19 nt, Artificial Sequence
  Description of Artificial Sequence: Synthetic oligonucleotide
aggccaccaccauguugau

SEQ ID NO: 1340 - RNA, 19 nt, Artificial Sequence
  Description of Artificial Sequence: Synthetic oligonucleotide
ggccaccaccauguugauc

SEQ ID NO: 1341 - RNA, 19 nt, Artificial Sequence
  Description of Artificial Sequence: Synthetic oligonucleotide
gccaccaccauguugaucc

SEQ ID NO: 1342 - RNA, 19 nt, Artificial Sequence
  Description of Artificial Sequence: Synthetic oligonucleotide
ccaccaccauguugaucca

SEQ ID NO: 1343 - RNA, 19 nt, Artificial Sequence
  Description of Artificial Sequence: Synthetic oligonucleotide
caccaccauguugauccag

SEQ ID NO: 1344 - RNA, 19 nt, Artificial Sequence
  Description of Artificial Sequence: Synthetic oligonucleotide
accaccauguugauccagc

SEQ ID NO: 1345 - RNA, 19 nt, Artificial Sequence
  Description of Artificial Sequence: Synthetic oligonucleotide
ccaccauguugauccagcc

SEQ ID NO: 1346 - RNA, 19 nt, Artificial Sequence
  Description of Artificial Sequence: Synthetic oligonucleotide
caccauguugauccagccc

SEQ ID NO: 1347 - RNA, 19 nt, Artificial Sequence
  Description of Artificial Sequence: Synthetic oligonucleotide
accauguugauccagccca

SEQ ID NO: 1348 - RNA, 19 nt, Artificial Sequence
  Description of Artificial Sequence: Synthetic oligonucleotide
ccauguugauccagcccau

SEQ ID NO: 1349 - RNA, 19 nt, Artificial Sequence
  Description of Artificial Sequence: Synthetic oligonucleotide
cauguugauccagcccaug

SEQ ID NO: 1350 - RNA, 19 nt, Artificial Sequence
  Description of Artificial Sequence: Synthetic oligonucleotide
auguugauccagcccaugg

SEQ ID NO: 1351 - RNA, 19 nt, Artificial Sequence
  Description of Artificial Sequence: Synthetic oligonucleotide
uguugauccagcccauggc

SEQ ID NO: 1352 - RNA, 19 nt, Artificial Sequence
  Description of Artificial Sequence: Synthetic oligonucleotide
guugauccagcccauggca

SEQ ID NO: 1353 - RNA, 19 nt, Artificial Sequence
  Description of Artificial Sequence: Synthetic oligonucleotide
uugauccagcccauggcag

SEQ ID NO: 1354 - RNA, 19 nt, Artificial Sequence
  Description of Artificial Sequence: Synthetic oligonucleotide
ugauccagcccauggcagc

SEQ ID NO: 1355 - RNA, 19 nt, Artificial Sequence
  Description of Artificial Sequence: Synthetic oligonucleotide
gauccagcccauggcagca

SEQ ID NO: 1356 - RNA, 19 nt, Artificial Sequence
  Description of Artificial Sequence: Synthetic oligonucleotide
auccagcccauggcagcag

SEQ ID NO: 1357 - RNA, 19 nt, Artificial Sequence
  Description of Artificial Sequence: Synthetic oligonucleotide
uccagcccauggcagcaga

SEQ ID NO: 1358 - RNA, 19 nt, Artificial Sequence
  Description of Artificial Sequence: Synthetic oligonucleotide
ccagcccauggcagcagag

SEQ ID NO: 1359 - RNA, 19 nt, Artificial Sequence
  Description of Artificial Sequence: Synthetic oligonucleotide
cagcccauggcagcagagg

SEQ ID NO: 1360 - RNA, 19 nt, Artificial Sequence
  Description of Artificial Sequence: Synthetic oligonucleotide
agcccauggcagcagaggc

SEQ ID NO: 1361 - RNA, 19 nt, Artificial Sequence
  Description of Artificial Sequence: Synthetic oligonucleotide
gcccauggcagcagaggca

SEQ ID NO: 1362 - RNA, 19 nt, Artificial Sequence
  Description of Artificial Sequence: Synthetic oligonucleotide
cccauggcagcagaggcag

SEQ ID NO: 1363 - RNA, 19 nt, Artificial Sequence
  Description of Artificial Sequence: Synthetic oligonucleotide
ccauggcagcagaggcagc

SEQ ID NO: 1364 - RNA, 19 nt, Artificial Sequence
  Description of Artificial Sequence: Synthetic oligonucleotide
cauggcagcagaggcagcc

SEQ ID NO: 1365 - RNA, 19 nt, Artificial Sequence
  Description of Artificial Sequence: Synthetic oligonucleotide
auggcagcagaggcagccu

SEQ ID NO: 1366 - RNA, 19 nt, Artificial Sequence
  Description of Artificial Sequence: Synthetic oligonucleotide
uggcagcagaggcagccuc

SEQ ID NO: 1367 - RNA, 19 nt, Artificial Sequence
  Description of Artificial Sequence: Synthetic oligonucleotide
ggcagcagaggcagccucc

SEQ ID NO: 1368 - RNA, 19 nt, Artificial Sequence
  Description of Artificial Sequence: Synthetic oligonucleotide
gcagcagaggcagccuccu

SEQ ID NO: 1369 - RNA, 19 nt, Artificial Sequence
  Description of Artificial Sequence: Synthetic oligonucleotide
cagcagaggcagccuccua

SEQ ID NO: 1370 - RNA, 19 nt, Artificial Sequence
  Description of Artificial Sequence: Synthetic oligonucleotide
agcagaggcagccuccuag

SEQ ID NO: 1371 - RNA, 19 nt, Artificial Sequence
  Description of Artificial Sequence: Synthetic oligonucleotide
gcagaggcagccuccuagc

SEQ ID NO: 1372 - RNA, 19 nt, Artificial Sequence
  Description of Artificial Sequence: Synthetic oligonucleotide
cagaggcagccuccuagcg

SEQ ID NO: 1373 - RNA, 19 nt, Artificial Sequence
  Description of Artificial Sequence: Synthetic oligonucleotide
agaggcagccuccuagcgu

SEQ ID NO: 1374 - RNA, 19 nt, Artificial Sequence
  Description of Artificial Sequence: Synthetic oligonucleotide
gaggcagccuccuagcguc

SEQ ID NO: 1375 - RNA, 19 nt, Artificial Sequence
  Description of Artificial Sequence: Synthetic oligonucleotide
aggcagccuccuagcgucc

SEQ ID NO: 1376 - RNA, 19 nt, Artificial Sequence
  Description of Artificial Sequence: Synthetic oligonucleotide
ggcagccuccuagcguccu

SEQ ID NO: 1377 - RNA, 19 nt, Artificial Sequence
  Description of Artificial Sequence: Synthetic oligonucleotide
gcagccuccuagcguccug

SEQ ID NO: 1378 - RNA, 19 nt, Artificial Sequence
  Description of Artificial Sequence: Synthetic oligonucleotide
cagccuccuagcguccugg

SEQ ID NO: 1379 - RNA, 19 nt, Artificial Sequence
  Description of Artificial Sequence: Synthetic oligonucleotide
agccuccuagcguccuggc

SEQ ID NO: 1380 - RNA, 19 nt, Artificial Sequence
  Description of Artificial Sequence: Synthetic oligonucleotide
gccuccuagcguccuggcu

SEQ ID NO: 1381 - RNA, 19 nt, Artificial Sequence
  Description of Artificial Sequence: Synthetic oligonucleotide
ccuccuagcguccuggcug

SEQ ID NO: 1382 - RNA, 19 nt, Artificial Sequence
  Description of Artificial Sequence: Synthetic oligonucleotide
cuccuagcguccuggcugg

SEQ ID NO: 1383 - RNA, 19 nt, Artificial Sequence
  Description of Artificial Sequence: Synthetic oligonucleotide
uccuagcguccuggcuggg

SEQ ID NO: 1384 - RNA, 19 nt, Artificial Sequence
  Description of Artificial Sequence: Synthetic oligonucleotide
ccuagcguccuggcugggc

SEQ ID NO: 1385 - RNA, 19 nt, Artificial Sequence
  Description of Artificial Sequence: Synthetic oligonucleotide
cuagcguccuggcugggcc

SEQ ID NO: 1386 - RNA, 19 nt, Artificial Sequence
  Description of Artificial Sequence: Synthetic oligonucleotide
uagcguccuggcugggccu

SEQ ID NO: 1387 - RNA, 19 nt, Artificial Sequence
  Description of Artificial Sequence: Synthetic oligonucleotide
agcguccuggcugggccug

SEQ ID NO: 1388 - RNA, 19 nt, Artificial Sequence
  Description of Artificial Sequence: Synthetic oligonucleotide
gcguccuggcugggccugg

SEQ ID NO: 1389 - RNA, 19 nt, Artificial Sequence
  Description of Artificial Sequence: Synthetic oligonucleotide
cguccuggcugggccuggu

SEQ ID NO: 1390 - RNA, 19 nt, Artificial Sequence
  Description of Artificial Sequence: Synthetic oligonucleotide
guccuggcugggccugguc

SEQ ID NO: 1391 - RNA, 19 nt, Artificial Sequence
  Description of Artificial Sequence: Synthetic oligonucleotide
uccuggcugggccuggucc

SEQ ID NO: 1392 - RNA, 19 nt, Artificial Sequence
  Description of Artificial Sequence: Synthetic oligonucleotide
ccuggcugggccugguccc

SEQ ID NO: 1393 - RNA, 19 nt, Artificial Sequence
  Description of Artificial Sequence: Synthetic oligonucleotide
cuggcugggccugguccca

SEQ ID NO: 1394 - RNA, 19 nt, Artificial Sequence
  Description of Artificial Sequence: Synthetic oligonucleotide
uggcugggccuggucccag

SEQ ID NO: 1395 - RNA, 19 nt, Artificial Sequence
  Description of Artificial Sequence: Synthetic oligonucleotide
ggcugggccuggucccagg

SEQ ID NO: 1396 - RNA, 19 nt, Artificial Sequence
  Description of Artificial Sequence: Synthetic oligonucleotide
gcugggccuggucccaggc

SEQ ID NO: 1397 - RNA, 19 nt, Artificial Sequence
  Description of Artificial Sequence: Synthetic oligonucleotide
cugggccuggucccaggcc

SEQ ID NO: 1398 - RNA, 19 nt, Artificial Sequence
  Description of Artificial Sequence: Synthetic oligonucleotide
ugggccuggucccaggccc

SEQ ID NO: 1399 - RNA, 19 nt, Artificial Sequence
  Description of Artificial Sequence: Synthetic oligonucleotide
gggccuggucccaggccca

SEQ ID NO: 1400 - RNA, 19 nt, Artificial Sequence
  Description of Artificial Sequence: Synthetic oligonucleotide
ggccuggucccaggcccac

SEQ ID NO: 1401 - RNA, 19 nt, Artificial Sequence
  Description of Artificial Sequence: Synthetic oligonucleotide
gccuggucccaggcccacg

SEQ ID NO: 1402 - RNA, 19 nt, Artificial Sequence
  Description of Artificial Sequence: Synthetic oligonucleotide
ccuggucccaggcccacga

SEQ ID NO: 1403 - RNA, 19 nt, Artificial Sequence
  Description of Artificial Sequence: Synthetic oligonucleotide
cuggucccaggcccacgaa

SEQ ID NO: 1404 - RNA, 19 nt, Artificial Sequence
  Description of Artificial Sequence: Synthetic oligonucleotide
uggucccaggcccacgaaa

SEQ ID NO: 1405 - RNA, 19 nt, Artificial Sequence
  Description of Artificial Sequence: Synthetic oligonucleotide
ggucccaggcccacgaaag

SEQ ID NO: 1406 - RNA, 19 nt, Artificial Sequence
  Description of Artificial Sequence: Synthetic oligonucleotide
gucccaggcccacgaaaga

SEQ ID NO: 1407 - RNA, 19 nt, Artificial Sequence
  Description of Artificial Sequence: Synthetic oligonucleotide
ucccaggcccacgaaagac

SEQ ID NO: 1408 - RNA, 19 nt, Artificial Sequence
  Description of Artificial Sequence: Synthetic oligonucleotide
cccaggcccacgaaagacg

SEQ ID NO: 1409 - RNA, 19 nt, Artificial Sequence
  Description of Artificial Sequence: Synthetic oligonucleotide
ccaggcccacgaaagacgg

SEQ ID NO: 1410 - RNA, 19 nt, Artificial Sequence
  Description of Artificial Sequence: Synthetic oligonucleotide
caggcccacgaaagacggu

SEQ ID NO: 1411 - RNA, 19 nt, Artificial Sequence
  Description of Artificial Sequence: Synthetic oligonucleotide
aggcccacgaaagacggug

SEQ ID NO: 1412 - RNA, 19 nt, Artificial Sequence
  Description of Artificial Sequence: Synthetic oligonucleotide
ggcccacgaaagacgguga

SEQ ID NO: 1413 - RNA, 19 nt, Artificial Sequence
  Description of Artificial Sequence: Synthetic oligonucleotide
gcccacgaaagacggugac

SEQ ID NO: 1414 - RNA, 19 nt, Artificial Sequence
  Description of Artificial Sequence: Synthetic oligonucleotide
cccacgaaagacggugacu

SEQ ID NO: 1415 - RNA, 19 nt, Artificial Sequence
  Description of Artificial Sequence: Synthetic oligonucleotide
ccacgaaagacggugacuc

SEQ ID NO: 1416 - RNA, 19 nt, Artificial Sequence
  Description of Artificial Sequence: Synthetic oligonucleotide
cacgaaagacggugacucu

SEQ ID NO: 1417 - RNA, 19 nt, Artificial Sequence
  Description of Artificial Sequence: Synthetic oligonucleotide
acgaaagacggugacucuu

SEQ ID NO: 1418 - RNA, 19 nt, Artificial Sequence
  Description of Artificial Sequence: Synthetic oligonucleotide
cgaaagacggugacucuug

SEQ ID NO: 1419 - RNA, 19 nt, Artificial Sequence
  Description of Artificial Sequence: Synthetic oligonucleotide
gaaagacggugacucuugg

SEQ ID NO: 1420 - RNA, 19 nt, Artificial Sequence
  Description of Artificial Sequence: Synthetic oligonucleotide
aaagacggugacucuuggc

SEQ ID NO: 1421 - RNA, 19 nt, Artificial Sequence
  Description of Artificial Sequence: Synthetic oligonucleotide
aagacggugacucuuggcu

SEQ ID NO: 1422 - RNA, 19 nt, Artificial Sequence
  Description of Artificial Sequence: Synthetic oligonucleotide
agacggugacucuuggcuc

SEQ ID NO: 1423 - RNA, 19 nt, Artificial Sequence
  Description of Artificial Sequence: Synthetic oligonucleotide
gacggugacucuuggcucu

SEQ ID NO: 1424 - RNA, 19 nt, Artificial Sequence
  Description of Artificial Sequence: Synthetic oligonucleotide
acggugacucuuggcucug

SEQ ID NO: 1425 - RNA, 19 nt, Artificial Sequence
  Description of Artificial Sequence: Synthetic oligonucleotide
cggugacucuuggcucugc

SEQ ID NO: 1426 - RNA, 19 nt, Artificial Sequence
  Description of Artificial Sequence: Synthetic oligonucleotide
ggugacucuuggcucugcc

SEQ ID NO: 1427 - RNA, 19 nt, Artificial Sequence
  Description of Artificial Sequence: Synthetic oligonucleotide
gugacucuuggcucugccc

SEQ ID NO: 1428 - RNA, 19 nt, Artificial Sequence
  Description of Artificial Sequence: Synthetic oligonucleotide
ugacucuuggcucugcccg

SEQ ID NO: 1429 - RNA, 19 nt, Artificial Sequence
  Description of Artificial Sequence: Synthetic oligonucleotide
gacucuuggcucugcccga

SEQ ID NO: 1430 - RNA, 19 nt, Artificial Sequence
  Description of Artificial Sequence: Synthetic oligonucleotide
acucuuggcucugcccgag

SEQ ID NO: 1431 - RNA, 19 nt, Artificial Sequence
  Description of Artificial Sequence: Synthetic oligonucleotide
cucuuggcucugcccgagg

SEQ ID NO: 1432 - RNA, 19 nt, Artificial Sequence
  Description of Artificial Sequence: Synthetic oligonucleotide
ucuuggcucugcccgagga

SEQ ID NO: 1433 - RNA, 19 nt, Artificial Sequence
  Description of Artificial Sequence: Synthetic oligonucleotide
cuuggcucugcccgaggau

SEQ ID NO: 1434 - RNA, 19 nt, Artificial Sequence
  Description of Artificial Sequence: Synthetic oligonucleotide
uuggcucugcccgaggaug

SEQ ID NO: 1435 - RNA, 19 nt, Artificial Sequence
  Description of Artificial Sequence: Synthetic oligonucleotide
uggcucugcccgaggaugu

SEQ ID NO: 1436 - RNA, 19 nt, Artificial Sequence
  Description of Artificial Sequence: Synthetic oligonucleotide
ggcucugcccgaggaugug

SEQ ID NO: 1437 - RNA, 19 nt, Artificial Sequence
  Description of Artificial Sequence: Synthetic oligonucleotide
gcucugcccgaggaugugg

SEQ ID NO: 1438 - RNA, 19 nt, Artificial Sequence
  Description of Artificial Sequence: Synthetic oligonucleotide
cucugcccgaggauguggc

SEQ ID NO: 1439 - RNA, 19 nt, Artificial Sequence
  Description of Artificial Sequence: Synthetic oligonucleotide
ucugcccgaggauguggcc

SEQ ID NO: 1440 - RNA, 19 nt, Artificial Sequence
  Description of Artificial Sequence: Synthetic oligonucleotide
cugcccgaggauguggccg

SEQ ID NO: 1441 - RNA, 19 nt, Artificial Sequence
  Description of Artificial Sequence: Synthetic oligonucleotide
ugcccgaggauguggccgu

SEQ ID NO: 1442 - RNA, 19 nt, Artificial Sequence
  Description of Artificial Sequence: Synthetic oligonucleotide
gcccgaggauguggccguu

SEQ ID NO: 1443 - RNA, 19 nt, Artificial Sequence
  Description of Artificial Sequence: Synthetic oligonucleotide
cccgaggauguggccguuc

SEQ ID NO: 1444 - RNA, 19 nt, Artificial Sequence
  Description of Artificial Sequence: Synthetic oligonucleotide
ccgaggauguggccguucc

SEQ ID NO: 1445 - RNA, 19 nt, Artificial Sequence
  Description of Artificial Sequence: Synthetic oligonucleotide
cgaggauguggccguuccc

SEQ ID NO: 1446 - RNA, 19 nt, Artificial Sequence
  Description of Artificial Sequence: Synthetic oligonucleotide
gaggauguggccguucccu

SEQ ID NO: 1447 - RNA, 19 nt, Artificial Sequence
  Description of Artificial Sequence: Synthetic oligonucleotide
aggauguggccguucccug

SEQ ID NO: 1448 - RNA, 19 nt, Artificial Sequence
  Description of Artificial Sequence: Synthetic oligonucleotide
ggauguggccguucccugc

SEQ ID NO: 1449 - RNA, 19 nt, Artificial Sequence
  Description of Artificial Sequence: Synthetic oligonucleotide
gauguggccguucccugcc

SEQ ID NO: 1450 - RNA, 19 nt, Artificial Sequence
  Description of Artificial Sequence: Synthetic oligonucleotide
auguggccguucccugccu

SEQ ID NO: 1451 - RNA, 19 nt, Artificial Sequence
  Description of Artificial Sequence: Synthetic oligonucleotide
uguggccguucccugccug

SEQ ID NO: 1452 - RNA, 19 nt, Artificial Sequence
  Description of Artificial Sequence: Synthetic oligonucleotide
guggccguucccugccugg

SEQ ID NO: 1453 - RNA, 19 nt, Artificial Sequence
  Description of Artificial Sequence: Synthetic oligonucleotide
uggccguucccugccuggg

SEQ ID NO: 1454 - RNA, 19 nt, Artificial Sequence
  Description of Artificial Sequence: Synthetic oligonucleotide
ggccguucccugccugggc

SEQ ID NO: 1455 - RNA, 19 nt, Artificial Sequence
  Description of Artificial Sequence: Synthetic oligonucleotide
gccguucccugccugggca

SEQ ID NO: 1456 - RNA, 19 nt, Artificial Sequence
  Description of Artificial Sequence: Synthetic oligonucleotide
ccguucccugccugggcag

SEQ ID NO: 1457 - RNA, 19 nt, Artificial Sequence
  Description of Artificial Sequence: Synthetic oligonucleotide
cguucccugccugggcagg

SEQ ID NO: 1458 - RNA, 19 nt, Artificial Sequence
  Description of Artificial Sequence: Synthetic oligonucleotide
guucccugccugggcaggg

SEQ ID NO: 1459 - RNA, 19 nt, Artificial Sequence
  Description of Artificial Sequence: Synthetic oligonucleotide
uucccugccugggcagggg

SEQ ID NO: 1460 - RNA, 19 nt, Artificial Sequence
  Description of Artificial Sequence: Synthetic oligonucleotide
ucccugccugggcaggggc

SEQ ID NO: 1461 - RNA, 19 nt, Artificial Sequence
  Description of Artificial Sequence: Synthetic oligonucleotide
cccugccugggcaggggcu

SEQ ID NO: 1462 - RNA, 19 nt, Artificial Sequence
  Description of Artificial Sequence: Synthetic oligonucleotide
ccugccugggcaggggcuc

SEQ ID NO: 1463 - RNA, 19 nt, Artificial Sequence
  Description of Artificial Sequence: Synthetic oligonucleotide
cugccugggcaggggcucc

SEQ ID NO: 1464 - RNA, 19 nt, Artificial Sequence
  Description of Artificial Sequence: Synthetic oligonucleotide
ugccugggcaggggcucca

SEQ ID NO: 1465 - RNA, 19 nt, Artificial Sequence
  Description of Artificial Sequence: Synthetic oligonucleotide
gccugggcaggggcuccaa

SEQ ID NO: 1466 - RNA, 19 nt, Artificial Sequence
  Description of Artificial Sequence: Synthetic oligonucleotide
ccugggcaggggcuccaag

SEQ ID NO: 1467 - RNA, 19 nt, Artificial Sequence
  Description of Artificial Sequence: Synthetic oligonucleotide
cugggcaggggcuccaagg

SEQ ID NO: 1468 - RNA, 19 nt, Artificial Sequence
  Description of Artificial Sequence: Synthetic oligonucleotide
ugggcaggggcuccaagga

SEQ ID NO: 1469 - RNA, 19 nt, Artificial Sequence
  Description of Artificial Sequence: Synthetic oligonucleotide
gggcaggggcuccaaggag

SEQ ID NO: 1470 - RNA, 19 nt, Artificial Sequence
  Description of Artificial Sequence: Synthetic oligonucleotide
ggcaggggcuccaaggagg

SEQ ID NO: 1471 - RNA, 19 nt, Artificial Sequence
  Description of Artificial Sequence: Synthetic oligonucleotide
gcaggggcuccaaggaggg

SEQ ID NO: 1472 - RNA, 19 nt, Artificial Sequence
  Description of Artificial Sequence: Synthetic oligonucleotide
caggggcuccaaggagggg

SEQ ID NO: 1473 - RNA, 19 nt, Artificial Sequence
  Description of Artificial Sequence: Synthetic oligonucleotide
aggggcuccaaggaggggc

SEQ ID NO: 1474 - RNA, 19 nt, Artificial Sequence
  Description of Artificial Sequence: Synthetic oligonucleotide
ggggcuccaaggaggggcc

SEQ ID NO: 1475 - RNA, 19 nt, Artificial Sequence
  Description of Artificial Sequence: Synthetic oligonucleotide
gggcuccaaggaggggcca

SEQ ID NO: 1476 - RNA, 19 nt, Artificial Sequence
  Description of Artificial Sequence: Synthetic oligonucleotide
ggcuccaaggaggggccau

SEQ ID NO: 1477 - RNA, 19 nt, Artificial Sequence
  Description of Artificial Sequence: Synthetic oligonucleotide
gcuccaaggaggggccauc

SEQ ID NO: 1478 - RNA, 19 nt, Artificial Sequence
  Description of Artificial Sequence: Synthetic oligonucleotide
cuccaaggaggggccaucu

SEQ ID NO: 1479 - RNA, 19 nt, Artificial Sequence
  Description of Artificial Sequence: Synthetic oligonucleotide
uccaaggaggggccaucug

SEQ ID NO: 1480 - RNA, 19 nt, Artificial Sequence
  Description of Artificial Sequence: Synthetic oligonucleotide
ccaaggaggggccaucugg

SEQ ID NO: 1481 - RNA, 19 nt, Artificial Sequence
  Description of Artificial Sequence: Synthetic oligonucleotide
caaggaggggccaucugga

SEQ ID NO: 1482 - RNA, 19 nt, Artificial Sequence
  Description of Artificial Sequence: Synthetic oligonucleotide
aaggaggggccaucuggaa

SEQ ID NO: 1483 - RNA, 19 nt, Artificial Sequence
  Description of Artificial Sequence: Synthetic oligonucleotide
aggaggggccaucuggaaa

SEQ ID NO: 1484 - RNA, 19 nt, Artificial Sequence
  Description of Artificial Sequence: Synthetic oligonucleotide
ggaggggccaucuggaaac

SEQ ID NO: 1485 - RNA, 19 nt, Artificial Sequence
  Description of Artificial Sequence: Synthetic oligonucleotide
gaggggccaucuggaaacu

SEQ ID NO: 1486 - RNA, 19 nt, Artificial Sequence
  Description of Artificial Sequence: Synthetic oligonucleotide
aggggccaucuggaaacuu

SEQ ID NO: 1487 - RNA, 19 nt, Artificial Sequence
  Description of Artificial Sequence: Synthetic oligonucleotide
ggggccaucuggaaacuug

SEQ ID NO: 1488 - RNA, 19 nt, Artificial Sequence
  Description of Artificial Sequence: Synthetic oligonucleotide
gggccaucuggaaacuugu

SEQ ID NO: 1489 - RNA, 19 nt, Artificial Sequence
  Description of Artificial Sequence: Synthetic oligonucleotide
ggccaucuggaaacuugug

SEQ ID NO: 1490 - RNA, 19 nt, Artificial Sequence
  Description of Artificial Sequence: Synthetic oligonucleotide
gccaucuggaaacuugugg

SEQ ID NO: 1491 - RNA, 19 nt, Artificial Sequence
  Description of Artificial Sequence: Synthetic oligonucleotide
ccaucuggaaacuugugga

SEQ ID NO: 1492 - RNA, 19 nt, Artificial Sequence
  Description of Artificial Sequence: Synthetic oligonucleotide
caucuggaaacuuguggac

SEQ ID NO: 1493 - RNA, 19 nt, Artificial Sequence
  Description of Artificial Sequence: Synthetic oligonucleotide
aucuggaaacuuguggaca

SEQ ID NO: 1494 - RNA, 19 nt, Artificial Sequence
  Description of Artificial Sequence: Synthetic oligonucleotide
ucuggaaacuuguggacag

SEQ ID NO: 1495 - RNA, 19 nt, Artificial Sequence
  Description of Artificial Sequence: Synthetic oligonucleotide
cuggaaacuuguggacaga

SEQ ID NO: 1496 - RNA, 19 nt, Artificial Sequence
  Description of Artificial Sequence: Synthetic oligonucleotide
uggaaacuuguggacagag

SEQ ID NO: 1497 - RNA, 19 nt, Artificial Sequence
  Description of Artificial Sequence: Synthetic oligonucleotide
ggaaacuuguggacagaga

SEQ ID NO: 1498 - RNA, 19 nt, Artificial Sequence
  Description of Artificial Sequence: Synthetic oligonucleotide
gaaacuuguggacagagaa

SEQ ID NO: 1499 - RNA, 19 nt, Artificial Sequence
  Description of Artificial Sequence: Synthetic oligonucleotide
aaacuuguggacagagaag

SEQ ID NO: 1500 - RNA, 19 nt, Artificial Sequence
  Description of Artificial Sequence: Synthetic oligonucleotide
aacuuguggacagagaaga

SEQ ID NO: 1501 - RNA, 19 nt, Artificial Sequence
  Description of Artificial Sequence: Synthetic oligonucleotide
acuuguggacagagaagaa

SEQ ID NO: 1502 - RNA, 19 nt, Artificial Sequence
  Description of Artificial Sequence: Synthetic oligonucleotide
cuuguggacagagaagaag

SEQ ID NO: 1503 - RNA, 19 nt, Artificial Sequence
  Description of Artificial Sequence: Synthetic oligonucleotide
uuguggacagagaagaaga

SEQ ID NO: 1504 - RNA, 19 nt, Artificial Sequence
  Description of Artificial Sequence: Synthetic oligonucleotide
uguggacagagaagaagac

SEQ ID NO: 1505 - RNA, 19 nt, Artificial Sequence
  Description of Artificial Sequence: Synthetic oligonucleotide
guggacagagaagaagacc

SEQ ID NO: 1506 - RNA, 19 nt, Artificial Sequence
  Description of Artificial Sequence: Synthetic oligonucleotide
uggacagagaagaagacca

SEQ ID NO: 1507 - RNA, 19 nt, Artificial Sequence
  Description of Artificial Sequence: Synthetic oligonucleotide
ggacagagaagaagaccac

SEQ ID NO: 1508 - RNA, 19 nt, Artificial Sequence
  Description of Artificial Sequence: Synthetic oligonucleotide
gacagagaagaagaccacg

SEQ ID NO: 1509 - RNA, 19 nt, Artificial Sequence
  Description of Artificial Sequence: Synthetic oligonucleotide
acagagaagaagaccacga

SEQ ID NO: 1510 - RNA, 19 nt, Artificial Sequence
  Description of Artificial Sequence: Synthetic oligonucleotide
cagagaagaagaccacgac

SEQ ID NO: 1511 - RNA, 19 nt, Artificial Sequence
  Description of Artificial Sequence: Synthetic oligonucleotide
agagaagaagaccacgacu

SEQ ID NO: 1512 - RNA, 19 nt, Artificial Sequence
  Description of Artificial Sequence: Synthetic oligonucleotide
gagaagaagaccacgacug

SEQ ID NO: 1513 - RNA, 19 nt, Artificial Sequence
  Description of Artificial Sequence: Synthetic oligonucleotide
agaagaagaccacgacugg

SEQ ID NO: 1514 - RNA, 19 nt, Artificial Sequence
  Description of Artificial Sequence: Synthetic oligonucleotide
gaagaagaccacgacugga

SEQ ID NO: 1515 - RNA, 19 nt, Artificial Sequence
  Description of Artificial Sequence: Synthetic oligonucleotide
aagaagaccacgacuggag

SEQ ID NO: 1516 - RNA, 19 nt, Artificial Sequence
  Description of Artificial Sequence: Synthetic oligonucleotide
agaagaccacgacuggaga

SEQ ID NO: 1517 - RNA, 19 nt, Artificial Sequence
  Description of Artificial Sequence: Synthetic oligonucleotide
gaagaccacgacuggagaa

SEQ ID NO: 1518 - RNA, 19 nt, Artificial Sequence
  Description of Artificial Sequence: Synthetic oligonucleotide
aagaccacgacuggagaag

SEQ ID NO: 1519 - RNA, 19 nt, Artificial Sequence
  Description of Artificial Sequence: Synthetic oligonucleotide
agaccacgacuggagaagc

SEQ ID NO: 1520 - RNA, 19 nt, Artificial Sequence
  Description of Artificial Sequence: Synthetic oligonucleotide
gaccacgacuggagaagcc

SEQ ID NO: 1521 - RNA, 19 nt, Artificial Sequence
  Description of Artificial Sequence: Synthetic oligonucleotide
accacgacuggagaagccc

SEQ ID NO: 1522 - RNA, 19 nt, Artificial Sequence
  Description of Artificial Sequence: Synthetic oligonucleotide
ccacgacuggagaagcccc

SEQ ID NO: 1523 - RNA, 19 nt, Artificial Sequence
  Description of Artificial Sequence: Synthetic oligonucleotide
cacgacuggagaagccccc

SEQ ID NO: 1524 - RNA, 19 nt, Artificial Sequence
  Description of Artificial Sequence: Synthetic oligonucleotide
acgacuggagaagcccccu

SEQ ID NO: 1525 - RNA, 19 nt, Artificial Sequence
  Description of Artificial Sequence: Synthetic oligonucleotide
cgacuggagaagcccccuu

SEQ ID NO: 1526 - RNA, 19 nt, Artificial Sequence
  Description of Artificial Sequence: Synthetic oligonucleotide
gacuggagaagcccccuuu

SEQ ID NO: 1527 - RNA, 19 nt, Artificial Sequence
  Description of Artificial Sequence: Synthetic oligonucleotide
acuggagaagcccccuuuc

SEQ ID NO: 1528 - RNA, 19 nt, Artificial Sequence
  Description of Artificial Sequence: Synthetic oligonucleotide
cuggagaagcccccuuucu

SEQ ID NO: 1529 - RNA, 19 nt, Artificial Sequence
  Description of Artificial Sequence: Synthetic oligonucleotide
uggagaagcccccuuucug

SEQ ID NO: 1530 - RNA, 19 nt, Artificial Sequence
  Description of Artificial Sequence: Synthetic oligonucleotide
ggagaagcccccuuucuga

SEQ ID NO: 1531 - RNA, 19 nt, Artificial Sequence
  Description of Artificial Sequence: Synthetic oligonucleotide
gagaagcccccuuucugag

SEQ ID NO: 1532 - RNA, 19 nt, Artificial Sequence
  Description of Artificial Sequence: Synthetic oligonucleotide
agaagcccccuuucugagu

SEQ ID NO: 1533 - RNA, 19 nt, Artificial Sequence
  Description of Artificial Sequence: Synthetic oligonucleotide
gaagcccccuuucugagug

SEQ ID NO: 1534 - RNA, 19 nt, Artificial Sequence
  Description of Artificial Sequence: Synthetic oligonucleotide
aagcccccuuucugagugc

SEQ ID NO: 1535 - RNA, 19 nt, Artificial Sequence
  Description of Artificial Sequence: Synthetic oligonucleotide
agcccccuuucugagugca

SEQ ID NO: 1536 - RNA, 19 nt, Artificial Sequence
  Description of Artificial Sequence: Synthetic oligonucleotide
gcccccuuucugagugcag

SEQ ID NO: 1537 - RNA, 19 nt, Artificial Sequence
  Description of Artificial Sequence: Synthetic oligonucleotide
cccccuuucugagugcagg

SEQ ID NO: 1538 - RNA, 19 nt, Artificial Sequence
  Description of Artificial Sequence: Synthetic oligonucleotide
ccccuuucugagugcaggg

SEQ ID NO: 1539 - RNA, 19 nt, Artificial Sequence
  Description of Artificial Sequence: Synthetic oligonucleotide
cccuuucugagugcagggg

SEQ ID NO: 1540 - RNA, 19 nt, Artificial Sequence
  Description of Artificial Sequence: Synthetic oligonucleotide
ccuuucugagugcaggggg

SEQ ID NO: 1541 - RNA, 19 nt, Artificial Sequence
  Description of Artificial Sequence: Synthetic oligonucleotide
cuuucugagugcagggggg

SEQ ID NO: 1542 - RNA, 19 nt, Artificial Sequence
  Description of Artificial Sequence: Synthetic oligonucleotide
uuucugagugcaggggggc

SEQ ID NO: 1543 - RNA, 19 nt, Artificial Sequence
  Description of Artificial Sequence: Synthetic oligonucleotide
uucugagugcaggggggcu

SEQ ID NO: 1544 - RNA, 19 nt, Artificial Sequence
  Description of Artificial Sequence: Synthetic oligonucleotide
ucugagugcaggggggcug

SEQ ID NO: 1545 - RNA, 19 nt, Artificial Sequence
  Description of Artificial Sequence: Synthetic oligonucleotide
cugagugcaggggggcugc

SEQ ID NO: 1546 - RNA, 19 nt, Artificial Sequence
  Description of Artificial Sequence: Synthetic oligonucleotide
ugagugcaggggggcugca

SEQ ID NO: 1547 - RNA, 19 nt, Artificial Sequence
  Description of Artificial Sequence: Synthetic oligonucleotide
gagugcaggggggcugcau

SEQ ID NO: 1548 - RNA, 19 nt, Artificial Sequence
  Description of Artificial Sequence: Synthetic oligonucleotide
agugcaggggggcugcaug

SEQ ID NO: 1549 - RNA, 19 nt, Artificial Sequence
  Description of Artificial Sequence: Synthetic oligonucleotide
gugcaggggggcugcaugc

SEQ ID NO: 1550 - RNA, 19 nt, Artificial Sequence
  Description of Artificial Sequence: Synthetic oligonucleotide
ugcaggggggcugcaugcg

SEQ ID NO: 1551 - RNA, 19 nt, Artificial Sequence
  Description of Artificial Sequence: Synthetic oligonucleotide
gcaggggggcugcaugcgu

SEQ ID NO: 1552 - RNA, 19 nt, Artificial Sequence
  Description of Artificial Sequence: Synthetic oligonucleotide
caggggggcugcaugcguu

SEQ ID NO: 1553 - RNA, 19 nt, Artificial Sequence
  Description of Artificial Sequence: Synthetic oligonucleotide
aggggggcugcaugcguug

SEQ ID NO: 1554 - RNA, 19 nt, Artificial Sequence
  Description of Artificial Sequence: Synthetic oligonucleotide
ggggggcugcaugcguugc

SEQ ID NO: 1555 - RNA, 19 nt, Artificial Sequence
  Description of Artificial Sequence: Synthetic oligonucleotide
gggggcugcaugcguugcc

SEQ ID NO: 1556 - RNA, 19 nt, Artificial Sequence
  Description of Artificial Sequence: Synthetic oligonucleotide
ggggcugcaugcguugccu

SEQ ID NO: 1557 - RNA, 19 nt, Artificial Sequence
  Description of Artificial Sequence: Synthetic oligonucleotide
gggcugcaugcguugccuc

SEQ ID NO: 1558 - RNA, 19 nt, Artificial Sequence
  Description of Artificial Sequence: Synthetic oligonucleotide
ggcugcaugcguugccucc

SEQ ID NO: 1559 - RNA, 19 nt, Artificial Sequence
  Description of Artificial Sequence: Synthetic oligonucleotide
gcugcaugcguugccuccu

SEQ ID NO: 1560 - RNA, 19 nt, Artificial Sequence
  Description of Artificial Sequence: Synthetic oligonucleotide
cugcaugcguugccuccug

SEQ ID NO: 1561 - RNA, 19 nt, Artificial Sequence
  Description of Artificial Sequence: Synthetic oligonucleotide
ugcaugcguugccuccuga

SEQ ID NO: 1562 - RNA, 19 nt, Artificial Sequence
  Description of Artificial Sequence: Synthetic oligonucleotide
gcaugcguugccuccugag

SEQ ID NO: 1563 - RNA, 19 nt, Artificial Sequence
  Description of Artificial Sequence: Synthetic oligonucleotide
caugcguugccuccugaga

SEQ ID NO: 1564 - RNA, 19 nt, Artificial Sequence
  Description of Artificial Sequence: Synthetic oligonucleotide
augcguugccuccugagau

SEQ ID NO: 1565 - RNA, 19 nt, Artificial Sequence
  Description of Artificial Sequence: Synthetic oligonucleotide
ugcguugccuccugagauc

SEQ ID NO: 1566 - RNA, 19 nt, Artificial Sequence
  Description of Artificial Sequence: Synthetic oligonucleotide
gcguugccuccugagaucg

SEQ ID NO: 1567 - RNA, 19 nt, Artificial Sequence
  Description of Artificial Sequence: Synthetic oligonucleotide
cguugccuccugagaucga

SEQ ID NO: 1568 - RNA, 19 nt, Artificial Sequence
  Description of Artificial Sequence: Synthetic oligonucleotide
guugccuccugagaucgag

SEQ ID NO: 1569 - RNA, 19 nt, Artificial Sequence
  Description of Artificial Sequence: Synthetic oligonucleotide
uugccuccugagaucgagg

SEQ ID NO: 1570 - RNA, 19 nt, Artificial Sequence
  Description of Artificial Sequence: Synthetic oligonucleotide
ugccuccugagaucgaggc

SEQ ID NO: 1571 - RNA, 19 nt, Artificial Sequence
  Description of Artificial Sequence: Synthetic oligonucleotide
gccuccugagaucgaggcu

SEQ ID NO: 1572 - RNA, 19 nt, Artificial Sequence
  Description of Artificial Sequence: Synthetic oligonucleotide
ccuccugagaucgaggcug

SEQ ID NO: 1573 - RNA, 19 nt, Artificial Sequence
  Description of Artificial Sequence: Synthetic oligonucleotide
cuccugagaucgaggcugc

SEQ ID NO: 1574 - RNA, 19 nt, Artificial Sequence
  Description of Artificial Sequence: Synthetic oligonucleotide
uccugagaucgaggcugca

SEQ ID NO: 1575 - RNA, 19 nt, Artificial Sequence
  Description of Artificial Sequence: Synthetic oligonucleotide
ccugagaucgaggcugcag

SEQ ID NO: 1576 - RNA, 19 nt, Artificial Sequence
  Description of Artificial Sequence: Synthetic oligonucleotide
cugagaucgaggcugcagg

SEQ ID NO: 1577 - RNA, 19 nt, Artificial Sequence
  Description of Artificial Sequence: Synthetic oligonucleotide
ugagaucgaggcugcagga

SEQ ID NO: 1578 - RNA, 19 nt, Artificial Sequence
  Description of Artificial Sequence: Synthetic oligonucleotide
gagaucgaggcugcaggau

SEQ ID NO: 1579 - RNA, 19 nt, Artificial Sequence
  Description of Artificial Sequence: Synthetic oligonucleotide
agaucgaggcugcaggaua

SEQ ID NO: 1580 - RNA, 19 nt, Artificial Sequence
  Description of Artificial Sequence: Synthetic oligonucleotide
gaucgaggcugcaggauau

SEQ ID NO: 1581 - RNA, 19 nt, Artificial Sequence
  Description of Artificial Sequence: Synthetic oligonucleotide
aucgaggcugcaggauaug

SEQ ID NO: 1582 - RNA, 19 nt, Artificial Sequence
  Description of Artificial Sequence: Synthetic oligonucleotide
ucgaggcugcaggauaugc

SEQ ID NO: 1583 - RNA, 19 nt, Artificial Sequence
  Description of Artificial Sequence: Synthetic oligonucleotide
cgaggcugcaggauaugcu

SEQ ID NO: 1584 - RNA, 19 nt, Artificial Sequence
  Description of Artificial Sequence: Synthetic oligonucleotide
gaggcugcaggauaugcuc

SEQ ID NO: 1585 - RNA, 19 nt, Artificial Sequence
  Description of Artificial Sequence: Synthetic oligonucleotide
aggcugcaggauaugcuca

SEQ ID NO: 1586 - RNA, 19 nt, Artificial Sequence
  Description of Artificial Sequence: Synthetic oligonucleotide
ggcugcaggauaugcucag

SEQ ID NO: 1587 - RNA, 19 nt, Artificial Sequence
  Description of Artificial Sequence: Synthetic oligonucleotide
gcugcaggauaugcucaga

SEQ ID NO: 1588 - RNA, 19 nt, Artificial Sequence
  Description of Artificial Sequence: Synthetic oligonucleotide
cugcaggauaugcucagac

SEQ ID NO: 1589 - RNA, 19 nt, Artificial Sequence
  Description of Artificial Sequence: Synthetic oligonucleotide
ugcaggauaugcucagacu

SEQ ID NO: 1590 - RNA, 19 nt, Artificial Sequence
  Description of Artificial Sequence: Synthetic oligonucleotide
gcaggauaugcucagacuc

SEQ ID NO: 1591 - RNA, 19 nt, Artificial Sequence
  Description of Artificial Sequence: Synthetic oligonucleotide
caggauaugcucagacucu

SEQ ID NO: 1592 - RNA, 19 nt, Artificial Sequence
  Description of Artificial Sequence: Synthetic oligonucleotide
aggauaugcucagacucua

SEQ ID NO: 1593 - RNA, 19 nt, Artificial Sequence
  Description of Artificial Sequence: Synthetic oligonucleotide
ggauaugcucagacucuag

SEQ ID NO: 1594 - RNA, 19 nt, Artificial Sequence
  Description of Artificial Sequence: Synthetic oligonucleotide
gauaugcucagacucuaga

SEQ ID NO: 1595 - RNA, 19 nt, Artificial Sequence
  Description of Artificial Sequence: Synthetic oligonucleotide
auaugcucagacucuagag

SEQ ID NO: 1596 - RNA, 19 nt, Artificial Sequence
  Description of Artificial Sequence: Synthetic oligonucleotide
uaugcucagacucuagagg

SEQ ID NO: 1597 - RNA, 19 nt, Artificial Sequence
  Description of Artificial Sequence: Synthetic oligonucleotide
augcucagacucuagaggc

SEQ ID NO: 1598 - RNA, 19 nt, Artificial Sequence
  Description of Artificial Sequence: Synthetic oligonucleotide
ugcucagacucuagaggcg

SEQ ID NO: 1599 - RNA, 19 nt, Artificial Sequence
  Description of Artificial Sequence: Synthetic oligonucleotide
gcucagacucuagaggcgu

SEQ ID NO: 1600 - RNA, 19 nt, Artificial Sequence
  Description of Artificial Sequence: Synthetic oligonucleotide
cucagacucuagaggcgug

SEQ ID NO: 1601 - RNA, 19 nt, Artificial Sequence
  Description of Artificial Sequence: Synthetic oligonucleotide
ucagacucuagaggcgugg

SEQ ID NO: 1602 - RNA, 19 nt, Artificial Sequence
  Description of Artificial Sequence: Synthetic oligonucleotide
cagacucuagaggcgugga

SEQ ID NO: 1603 - RNA, 19 nt, Artificial Sequence
  Description of Artificial Sequence: Synthetic oligonucleotide
agacucuagaggcguggac

SEQ ID NO: 1604 - RNA, 19 nt, Artificial Sequence
  Description of Artificial Sequence: Synthetic oligonucleotide
gacucuagaggcguggacc

SEQ ID NO: 1605 - RNA, 19 nt, Artificial Sequence
  Description of Artificial Sequence: Synthetic oligonucleotide
acucuagaggcguggacca

SEQ ID NO: 1606 - RNA, 19 nt, Artificial Sequence
  Description of Artificial Sequence: Synthetic oligonucleotide
cucuagaggcguggaccaa

SEQ ID NO: 1607 - RNA, 19 nt, Artificial Sequence
  Description of Artificial Sequence: Synthetic oligonucleotide
ucuagaggcguggaccaag

SEQ ID NO: 1608 - RNA, 19 nt, Artificial Sequence
  Description of Artificial Sequence: Synthetic oligonucleotide
cuagaggcguggaccaagg

SEQ ID NO: 1609 - RNA, 19 nt, Artificial Sequence
  Description of Artificial Sequence: Synthetic oligonucleotide
uagaggcguggaccaaggg

SEQ ID NO: 1610 - RNA, 19 nt, Artificial Sequence
  Description of Artificial Sequence: Synthetic oligonucleotide
agaggcguggaccaagggg

SEQ ID NO: 1611 - RNA, 19 nt, Artificial Sequence
  Description of Artificial Sequence: Synthetic oligonucleotide
gaggcguggaccaaggggc

SEQ ID NO: 1612 - RNA, 19 nt, Artificial Sequence
  Description of Artificial Sequence: Synthetic oligonucleotide
aggcguggaccaaggggca

SEQ ID NO: 1613 - RNA, 19 nt, Artificial Sequence
  Description of Artificial Sequence: Synthetic oligonucleotide
ggcguggaccaaggggcau

SEQ ID NO: 1614 - RNA, 19 nt, Artificial Sequence
  Description of Artificial Sequence: Synthetic oligonucleotide
gcguggaccaaggggcaug

SEQ ID NO: 1615 - RNA, 19 nt, Artificial Sequence
  Description of Artificial Sequence: Synthetic oligonucleotide
cguggaccaaggggcaugg

SEQ ID NO: 1616 - RNA, 19 nt, Artificial Sequence
  Description of Artificial Sequence: Synthetic oligonucleotide
guggaccaaggggcaugga

SEQ ID NO: 1617 - RNA, 19 nt, Artificial Sequence
  Description of Artificial Sequence: Synthetic oligonucleotide
uggaccaaggggcauggag

SEQ ID NO: 1618 - RNA, 19 nt, Artificial Sequence
  Description of Artificial Sequence: Synthetic oligonucleotide
ggaccaaggggcauggagc

SEQ ID NO: 1619 - RNA, 19 nt, Artificial Sequence
  Description of Artificial Sequence: Synthetic oligonucleotide
gaccaaggggcauggagcu

SEQ ID NO: 1620 - RNA, 19 nt, Artificial Sequence
  Description of Artificial Sequence: Synthetic oligonucleotide
accaaggggcauggagcuu

SEQ ID NO: 1621 - RNA, 19 nt, Artificial Sequence
  Description of Artificial Sequence: Synthetic oligonucleotide
ccaaggggcauggagcuuc

SEQ ID NO: 1622 - RNA, 19 nt, Artificial Sequence
  Description of Artificial Sequence: Synthetic oligonucleotide
caaggggcauggagcuuca

SEQ ID NO: 1623 - RNA, 19 nt, Artificial Sequence
  Description of Artificial Sequence: Synthetic oligonucleotide
aaggggcauggagcuucac

SEQ ID NO: 1624 - RNA, 19 nt, Artificial Sequence
  Description of Artificial Sequence: Synthetic oligonucleotide
aggggcauggagcuucacu

SEQ ID NO: 1625 - RNA, 19 nt, Artificial Sequence
  Description of Artificial Sequence: Synthetic oligonucleotide
ggggcauggagcuucacuc

SEQ ID NO: 1626 - RNA, 19 nt, Artificial Sequence
  Description of Artificial Sequence: Synthetic oligonucleotide
gggcauggagcuucacucc

SEQ ID NO: 1627 - RNA, 19 nt, Artificial Sequence
  Description of Artificial Sequence: Synthetic oligonucleotide
ggcauggagcuucacuccu

SEQ ID NO: 1628 - RNA, 19 nt, Artificial Sequence
  Description of Artificial Sequence: Synthetic oligonucleotide
gcauggagcuucacuccuu

SEQ ID NO: 1629 - RNA, 19 nt, Artificial Sequence
  Description of Artificial Sequence: Synthetic oligonucleotide
cauggagcuucacuccuug

SEQ ID NO: 1630 - RNA, 19 nt, Artificial Sequence
  Description of Artificial Sequence: Synthetic oligonucleotide
auggagcuucacuccuugc

SEQ ID NO: 1631 - RNA, 19 nt, Artificial Sequence
  Description of Artificial Sequence: Synthetic oligonucleotide
uggagcuucacuccuugcu

SEQ ID NO: 1632 - RNA, 19 nt, Artificial Sequence
  Description of Artificial Sequence: Synthetic oligonucleotide
ggagcuucacuccuugcug

SEQ ID NO: 1633 - RNA, 19 nt, Artificial Sequence
  Description of Artificial Sequence: Synthetic oligonucleotide
gagcuucacuccuugcugg

SEQ ID NO: 1634 - RNA, 19 nt, Artificial Sequence
  Description of Artificial Sequence: Synthetic oligonucleotide
agcuucacuccuugcuggc

SEQ ID NO: 1635 - RNA, 19 nt, Artificial Sequence
  Description of Artificial Sequence: Synthetic oligonucleotide
gcuucacuccuugcuggcc

SEQ ID NO: 1636 - RNA, 19 nt, Artificial Sequence
  Description of Artificial Sequence: Synthetic oligonucleotide
cuucacuccuugcuggcca

SEQ ID NO: 1637 - RNA, 19 nt, Artificial Sequence
  Description of Artificial Sequence: Synthetic oligonucleotide
uucacuccuugcuggccag

SEQ ID NO: 1638 - RNA, 19 nt, Artificial Sequence
  Description of Artificial Sequence: Synthetic oligonucleotide
ucacuccuugcuggccagg

SEQ ID NO: 1639 - RNA, 19 nt, Artificial Sequence
  Description of Artificial Sequence: Synthetic oligonucleotide
cacuccuugcuggccaggg

SEQ ID NO: 1640 - RNA, 19 nt, Artificial Sequence
  Description of Artificial Sequence: Synthetic oligonucleotide
acuccuugcuggccaggga

SEQ ID NO: 1641 - RNA, 19 nt, Artificial Sequence
  Description of Artificial Sequence: Synthetic oligonucleotide
cuccuugcuggccagggag

SEQ ID NO: 1642 - RNA, 19 nt, Artificial Sequence
  Description of Artificial Sequence: Synthetic oligonucleotide
uccuugcuggccagggagu

SEQ ID NO: 1643 - RNA, 19 nt, Artificial Sequence
  Description of Artificial Sequence: Synthetic oligonucleotide
ccuugcuggccagggaguu

SEQ ID NO: 1644 - RNA, 19 nt, Artificial Sequence
  Description of Artificial Sequence: Synthetic oligonucleotide
cuugcuggccagggaguug

SEQ ID NO: 1645 - RNA, 19 nt, Artificial Sequence
  Description of Artificial Sequence: Synthetic oligonucleotide
uugcuggccagggaguugg

SEQ ID NO: 1646 - RNA, 19 nt, Artificial Sequence
  Description of Artificial Sequence: Synthetic oligonucleotide
ugcuggccagggaguuggg

SEQ ID NO: 1647 - RNA, 19 nt, Artificial Sequence
  Description of Artificial Sequence: Synthetic oligonucleotide
gcuggccagggaguugggg

SEQ ID NO: 1648 - RNA, 19 nt, Artificial Sequence
  Description of Artificial Sequence: Synthetic oligonucleotide
cuggccagggaguugggga

SEQ ID NO: 1649 - RNA, 19 nt, Artificial Sequence
  Description of Artificial Sequence: Synthetic oligonucleotide
uggccagggaguuggggac

SEQ ID NO: 1650 - RNA, 19 nt, Artificial Sequence
  Description of Artificial Sequence: Synthetic oligonucleotide
ggccagggaguuggggacu

SEQ ID NO: 1651 - RNA, 19 nt, Artificial Sequence
  Description of Artificial Sequence: Synthetic oligonucleotide
gccagggaguuggggacuc

SEQ ID NO: 1652 - RNA, 19 nt, Artificial Sequence
  Description of Artificial Sequence: Synthetic oligonucleotide
ccagggaguuggggacuca

SEQ ID NO: 1653 - RNA, 19 nt, Artificial Sequence
  Description of Artificial Sequence: Synthetic oligonucleotide
cagggaguuggggacucag

SEQ ID NO: 1654 - RNA, 19 nt, Artificial Sequence
  Description of Artificial Sequence: Synthetic oligonucleotide
agggaguuggggacucaga

SEQ ID NO: 1655 - RNA, 19 nt, Artificial Sequence
  Description of Artificial Sequence: Synthetic oligonucleotide
gggaguuggggacucagag

SEQ ID NO: 1656 - RNA, 19 nt, Artificial Sequence
  Description of Artificial Sequence: Synthetic oligonucleotide
ggaguuggggacucagagg

SEQ ID NO: 1657 - RNA, 19 nt, Artificial Sequence
  Description of Artificial Sequence: Synthetic oligonucleotide
gaguuggggacucagaggg

SEQ ID NO: 1658 - RNA, 19 nt, Artificial Sequence
  Description of Artificial Sequence: Synthetic oligonucleotide
aguuggggacucagaggga

SEQ ID NO: 1659 - RNA, 19 nt, Artificial Sequence
  Description of Artificial Sequence: Synthetic oligonucleotide
guuggggacucagagggac

SEQ ID NO: 1660 - RNA, 19 nt, Artificial Sequence
  Description of Artificial Sequence: Synthetic oligonucleotide
uuggggacucagagggacc

SEQ ID NO: 1661 - RNA, 19 nt, Artificial Sequence
  Description of Artificial Sequence: Synthetic oligonucleotide
uggggacucagagggacca

SEQ ID NO: 1662 - RNA, 19 nt, Artificial Sequence
  Description of Artificial Sequence: Synthetic oligonucleotide
ggggacucagagggaccac

SEQ ID NO: 1663 - RNA, 19 nt, Artificial Sequence
  Description of Artificial Sequence: Synthetic oligonucleotide
gggacucagagggaccacu

SEQ ID NO: 1664 - RNA, 19 nt, Artificial Sequence
  Description of Artificial Sequence: Synthetic oligonucleotide
ggacucagagggaccacuu

SEQ ID NO: 1665 - RNA, 19 nt, Artificial Sequence
  Description of Artificial Sequence: Synthetic oligonucleotide
gacucagagggaccacuug

SEQ ID NO: 1666 - RNA, 19 nt, Artificial Sequence
  Description of Artificial Sequence: Synthetic oligonucleotide
acucagagggaccacuugg

SEQ ID NO: 1667 - RNA, 19 nt, Artificial Sequence
  Description of Artificial Sequence: Synthetic oligonucleotide
cucagagggaccacuuggg

SEQ ID NO: 1668 - RNA, 19 nt, Artificial Sequence
  Description of Artificial Sequence: Synthetic oligonucleotide
ucagagggaccacuugggg

SEQ ID NO: 1669 - RNA, 19 nt, Artificial Sequence
  Description of Artificial Sequence: Synthetic oligonucleotide
cagagggaccacuuggggc

SEQ ID NO: 1670 - RNA, 19 nt, Artificial Sequence
  Description of Artificial Sequence: Synthetic oligonucleotide
agagggaccacuuggggcc

SEQ ID NO: 1671 - RNA, 19 nt, Artificial Sequence
  Description of Artificial Sequence: Synthetic oligonucleotide
gagggaccacuuggggcca

SEQ ID NO: 1672 - RNA, 19 nt, Artificial Sequence
  Description of Artificial Sequence: Synthetic oligonucleotide
agggaccacuuggggccag

SEQ ID NO: 1673 - RNA, 19 nt, Artificial Sequence
  Description of Artificial Sequence: Synthetic oligonucleotide
gggaccacuuggggccagc

SEQ ID NO: 1674 - RNA, 19 nt, Artificial Sequence
  Description of Artificial Sequence: Synthetic oligonucleotide
ggaccacuuggggccagcc

SEQ ID NO: 1675 - RNA, 19 nt, Artificial Sequence
  Description of Artificial Sequence: Synthetic oligonucleotide
gaccacuuggggccagcca

SEQ ID NO: 1676 - RNA, 19 nt, Artificial Sequence
  Description of Artificial Sequence: Synthetic oligonucleotide
accacuuggggccagccag

SEQ ID NO: 1677 - RNA, 19 nt, Artificial Sequence
  Description of Artificial Sequence: Synthetic oligonucleotide
ccacuuggggccagccaga

SEQ ID NO: 1678 - RNA, 19 nt, Artificial Sequence
  Description of Artificial Sequence: Synthetic oligonucleotide
cacuuggggccagccagac

SEQ ID NO: 1679 - RNA, 19 nt, Artificial Sequence
  Description of Artificial Sequence: Synthetic oligonucleotide
acuuggggccagccagacu

SEQ ID NO: 1680 - RNA, 19 nt, Artificial Sequence
  Description of Artificial Sequence: Synthetic oligonucleotide
cuuggggccagccagacug

SEQ ID NO: 1681 - RNA, 19 nt, Artificial Sequence
  Description of Artificial Sequence: Synthetic oligonucleotide
uuggggccagccagacugg

SEQ ID NO: 1682 - RNA, 19 nt, Artificial Sequence
  Description of Artificial Sequence: Synthetic oligonucleotide
uggggccagccagacuggc

SEQ ID NO: 1683 - RNA, 19 nt, Artificial Sequence
  Description of Artificial Sequence: Synthetic oligonucleotide
ggggccagccagacuggcc

SEQ ID NO: 1684 - RNA, 19 nt, Artificial Sequence
  Description of Artificial Sequence: Synthetic oligonucleotide
gggccagccagacuggccu

SEQ ID NO: 1685 - RNA, 19 nt, Artificial Sequence
  Description of Artificial Sequence: Synthetic oligonucleotide
ggccagccagacuggccuc

SEQ ID NO: 1686 - RNA, 19 nt, Artificial Sequence
  Description of Artificial Sequence: Synthetic oligonucleotide
gccagccagacuggccuca

SEQ ID NO: 1687 - RNA, 19 nt, Artificial Sequence
  Description of Artificial Sequence: Synthetic oligonucleotide
ccagccagacuggccucaa

SEQ ID NO: 1688 - RNA, 19 nt, Artificial Sequence
  Description of Artificial Sequence: Synthetic oligonucleotide
cagccagacuggccucaau

SEQ ID NO: 1689 - RNA, 19 nt, Artificial Sequence
  Description of Artificial Sequence: Synthetic oligonucleotide
agccagacuggccucaaug

SEQ ID NO: 1690 - RNA, 19 nt, Artificial Sequence
  Description of Artificial Sequence: Synthetic oligonucleotide
gccagacuggccucaaugg

SEQ ID NO: 1691 - RNA, 19 nt, Artificial Sequence
  Description of Artificial Sequence: Synthetic oligonucleotide
ccagacuggccucaauggc

SEQ ID NO: 1692 - RNA, 19 nt, Artificial Sequence
  Description of Artificial Sequence: Synthetic oligonucleotide
cagacuggccucaauggcg

SEQ ID NO: 1693 - RNA, 19 nt, Artificial Sequence
  Description of Artificial Sequence: Synthetic oligonucleotide
agacuggccucaauggcgg

SEQ ID NO: 1694 - RNA, 19 nt, Artificial Sequence
  Description of Artificial Sequence: Synthetic oligonucleotide
gacuggccucaauggcgga

SEQ ID NO: 1695 - RNA, 19 nt, Artificial Sequence
  Description of Artificial Sequence: Synthetic oligonucleotide
acuggccucaauggcggac

SEQ ID NO: 1696 - RNA, 19 nt, Artificial Sequence
  Description of Artificial Sequence: Synthetic oligonucleotide
cuggccucaauggcggacu

SEQ ID NO: 1697 - RNA, 19 nt, Artificial Sequence
  Description of Artificial Sequence: Synthetic oligonucleotide
uggccucaauggcggacuc

SEQ ID NO: 1698 - RNA, 19 nt, Artificial Sequence
  Description of Artificial Sequence: Synthetic oligonucleotide
ggccucaauggcggacuca

SEQ ID NO: 1699 - RNA, 19 nt, Artificial Sequence
  Description of Artificial Sequence: Synthetic oligonucleotide
gccucaauggcggacucag

SEQ ID NO: 1700 - RNA, 19 nt, Artificial Sequence
  Description of Artificial Sequence: Synthetic oligonucleotide
ccucaauggcggacucagu

SEQ ID NO: 1701 - RNA, 19 nt, Artificial Sequence
  Description of Artificial Sequence: Synthetic oligonucleotide
cucaauggcggacucaguc

SEQ ID NO: 1702 - RNA, 19 nt, Artificial Sequence
  Description of Artificial Sequence: Synthetic oligonucleotide
ucaauggcggacucaguca

SEQ ID NO: 1703 - RNA, 19 nt, Artificial Sequence
  Description of Artificial Sequence: Synthetic oligonucleotide
caauggcggacucagucac

SEQ ID NO: 1704 - RNA, 19 nt, Artificial Sequence
  Description of Artificial Sequence: Synthetic oligonucleotide
aauggcggacucagucaca

SEQ ID NO: 1705 - RNA, 19 nt, Artificial Sequence
  Description of Artificial Sequence: Synthetic oligonucleotide
auggcggacucagucacau

SEQ ID NO: 1706 - RNA, 19 nt, Artificial Sequence
  Description of Artificial Sequence: Synthetic oligonucleotide
uggcggacucagucacauu

SEQ ID NO: 1707 - RNA, 19 nt, Artificial Sequence
  Description of Artificial Sequence: Synthetic oligonucleotide
ggcggacucagucacauug

SEQ ID NO: 1708 - RNA, 19 nt, Artificial Sequence
  Description of Artificial Sequence: Synthetic oligonucleotide
gcggacucagucacauuga

SEQ ID NO: 1709 - RNA, 19 nt, Artificial Sequence
  Description of Artificial Sequence: Synthetic oligonucleotide
cggacucagucacauugac

SEQ ID NO: 1710 - RNA, 19 nt, Artificial Sequence
  Description of Artificial Sequence: Synthetic oligonucleotide
ggacucagucacauugacu

SEQ ID NO: 1711 - RNA, 19 nt, Artificial Sequence
  Description of Artificial Sequence: Synthetic oligonucleotide
gacucagucacauugacug

SEQ ID NO: 1712 - RNA, 19 nt, Artificial Sequence
  Description of Artificial Sequence: Synthetic oligonucleotide
acucagucacauugacuga

SEQ ID NO: 1713 - RNA, 19 nt, Artificial Sequence
  Description of Artificial Sequence: Synthetic oligonucleotide
cucagucacauugacugac

SEQ ID NO: 1714 - RNA, 19 nt, Artificial Sequence
  Description of Artificial Sequence: Synthetic oligonucleotide
ucagucacauugacugacg

SEQ ID NO: 1715 - RNA, 19 nt, Artificial Sequence
  Description of Artificial Sequence: Synthetic oligonucleotide
cagucacauugacugacgg

SEQ ID NO: 1716 - RNA, 19 nt, Artificial Sequence
  Description of Artificial Sequence: Synthetic oligonucleotide
agucacauugacugacggg

SEQ ID NO: 1717 - RNA, 19 nt, Artificial Sequence
  Description of Artificial Sequence: Synthetic oligonucleotide
gucacauugacugacgggg

SEQ ID NO: 1718 - RNA, 19 nt, Artificial Sequence
  Description of Artificial Sequence: Synthetic oligonucleotide
ucacauugacugacgggga

SEQ ID NO: 1719 - RNA, 19 nt, Artificial Sequence
  Description of Artificial Sequence: Synthetic oligonucleotide
cacauugacugacggggac

SEQ ID NO: 1720 - RNA, 19 nt, Artificial Sequence
  Description of Artificial Sequence: Synthetic oligonucleotide
acauugacugacggggacc

SEQ ID NO: 1721 - RNA, 19 nt, Artificial Sequence
  Description of Artificial Sequence: Synthetic oligonucleotide
cauugacugacggggacca

SEQ ID NO: 1722 - RNA, 19 nt, Artificial Sequence
  Description of Artificial Sequence: Synthetic oligonucleotide
auugacugacggggaccag

SEQ ID NO: 1723 - RNA, 19 nt, Artificial Sequence
  Description of Artificial Sequence: Synthetic oligonucleotide
uugacugacggggaccagg

SEQ ID NO: 1724 - RNA, 19 nt, Artificial Sequence
  Description of Artificial Sequence: Synthetic oligonucleotide
ugacugacggggaccaggg

SEQ ID NO: 1725 - RNA, 19 nt, Artificial Sequence
  Description of Artificial Sequence: Synthetic oligonucleotide
gacugacggggaccagggc

SEQ ID NO: 1726 - RNA, 19 nt, Artificial Sequence
  Description of Artificial Sequence: Synthetic oligonucleotide
acugacggggaccagggcu

SEQ ID NO: 1727 - RNA, 19 nt, Artificial Sequence
  Description of Artificial Sequence: Synthetic oligonucleotide
cugacggggaccagggcuu

SEQ ID NO: 1728 - RNA, 19 nt, Artificial Sequence
  Description of Artificial Sequence: Synthetic oligonucleotide
ugacggggaccagggcuug

SEQ ID NO: 1729 - RNA, 19 nt, Artificial Sequence
  Description of Artificial Sequence: Synthetic oligonucleotide
gacggggaccagggcuugu

SEQ ID NO: 1730 - RNA, 19 nt, Artificial Sequence
  Description of Artificial Sequence: Synthetic oligonucleotide
acggggaccagggcuugug

SEQ ID NO: 1731 - RNA, 19 nt, Artificial Sequence
  Description of Artificial Sequence: Synthetic oligonucleotide
cggggaccagggcuugugu

SEQ ID NO: 1732 - RNA, 19 nt, Artificial Sequence
  Description of Artificial Sequence: Synthetic oligonucleotide
ggggaccagggcuugugug

SEQ ID NO: 1733 - RNA, 19 nt, Artificial Sequence
  Description of Artificial Sequence: Synthetic oligonucleotide
gggaccagggcuugugugg

SEQ ID NO: 1734 - RNA, 19 nt, Artificial Sequence
  Description of Artificial Sequence: Synthetic oligonucleotide
ggaccagggcuuguguggg

SEQ ID NO: 1735 - RNA, 19 nt, Artificial Sequence
  Description of Artificial Sequence: Synthetic oligonucleotide
gaccagggcuugugugggu

SEQ ID NO: 1736 - RNA, 19 nt, Artificial Sequence
  Description of Artificial Sequence: Synthetic oligonucleotide
accagggcuuguguggguc

SEQ ID NO: 1737 - RNA, 19 nt, Artificial Sequence
  Description of Artificial Sequence: Synthetic oligonucleotide
ccagggcuugugugggucg

SEQ ID NO: 1738 - RNA, 19 nt, Artificial Sequence
  Description of Artificial Sequence: Synthetic oligonucleotide
cagggcuugugugggucga

SEQ ID NO: 1739 - RNA, 19 nt, Artificial Sequence
  Description of Artificial Sequence: Synthetic oligonucleotide
agggcuugugugggucgag

SEQ ID NO: 1740 - RNA, 19 nt, Artificial Sequence
  Description of Artificial Sequence: Synthetic oligonucleotide
gggcuugugugggucgaga

SEQ ID NO: 1741 - RNA, 19 nt, Artificial Sequence
  Description of Artificial Sequence: Synthetic oligonucleotide
ggcuugugugggucgagag

SEQ ID NO: 1742 - RNA, 19 nt, Artificial Sequence
  Description of Artificial Sequence: Synthetic oligonucleotide
gcuugugugggucgagagc

SEQ ID NO: 1743 - RNA, 19 nt, Artificial Sequence
  Description of Artificial Sequence: Synthetic oligonucleotide
cuugugugggucgagagcg

SEQ ID NO: 1744 - RNA, 19 nt, Artificial Sequence
  Description of Artificial Sequence: Synthetic oligonucleotide
uugugugggucgagagcgc

SEQ ID NO: 1745 - RNA, 19 nt, Artificial Sequence
  Description of Artificial Sequence: Synthetic oligonucleotide
ugugugggucgagagcgcc

SEQ ID NO: 1746 - RNA, 19 nt, Artificial Sequence
  Description of Artificial Sequence: Synthetic oligonucleotide
gugugggucgagagcgccc

SEQ ID NO: 1747 - RNA, 19 nt, Artificial Sequence
  Description of Artificial Sequence: Synthetic oligonucleotide
ugugggucgagagcgcccu

SEQ ID NO: 1748 - RNA, 19 nt, Artificial Sequence
  Description of Artificial Sequence: Synthetic oligonucleotide
gugggucgagagcgcccuc

SEQ ID NO: 1749 - RNA, 19 nt, Artificial Sequence
  Description of Artificial Sequence: Synthetic oligonucleotide
ugggucgagagcgcccuca

SEQ ID NO: 1750 - RNA, 19 nt, Artificial Sequence
  Description of Artificial Sequence: Synthetic oligonucleotide
gggucgagagcgcccucau

SEQ ID NO: 1751 - RNA, 19 nt, Artificial Sequence
  Description of Artificial Sequence: Synthetic oligonucleotide
ggucgagagcgcccucaug

SEQ ID NO: 1752 - RNA, 19 nt, Artificial Sequence
  Description of Artificial Sequence: Synthetic oligonucleotide
gucgagagcgcccucaugg

SEQ ID NO: 1753 - RNA, 19 nt, Artificial Sequence
  Description of Artificial Sequence: Synthetic oligonucleotide
ucgagagcgcccucauggu

SEQ ID NO: 1754 - RNA, 19 nt, Artificial Sequence
  Description of Artificial Sequence: Synthetic oligonucleotide
cgagagcgcccucauggug

SEQ ID NO: 1755 - RNA, 19 nt, Artificial Sequence
  Description of Artificial Sequence: Synthetic oligonucleotide
gagagcgcccucauggugc

SEQ ID NO: 1756 - RNA, 19 nt, Artificial Sequence
  Description of Artificial Sequence: Synthetic oligonucleotide
agagcgcccucauggugcu

SEQ ID NO: 1757 - RNA, 19 nt, Artificial Sequence
  Description of Artificial Sequence: Synthetic oligonucleotide
gagcgcccucauggugcug

SEQ ID NO: 1758 - RNA, 19 nt, Artificial Sequence
  Description of Artificial Sequence: Synthetic oligonucleotide
agcgcccucauggugcugg

SEQ ID NO: 1759 - RNA, 19 nt, Artificial Sequence
  Description of Artificial Sequence: Synthetic oligonucleotide
gcgcccucauggugcuggu

SEQ ID NO: 1760 - RNA, 19 nt, Artificial Sequence
  Description of Artificial Sequence: Synthetic oligonucleotide
cgcccucauggugcuggug

SEQ ID NO: 1761 - RNA, 19 nt, Artificial Sequence
  Description of Artificial Sequence: Synthetic oligonucleotide
gcccucauggugcuggugc

SEQ ID NO: 1762 - RNA, 19 nt, Artificial Sequence
  Description of Artificial Sequence: Synthetic oligonucleotide
cccucauggugcuggugcu

SEQ ID NO: 1763 - RNA, 19 nt, Artificial Sequence
  Description of Artificial Sequence: Synthetic oligonucleotide
ccucauggugcuggugcug

SEQ ID NO: 1764 - RNA, 19 nt, Artificial Sequence
  Description of Artificial Sequence: Synthetic oligonucleotide
cucauggugcuggugcugu

SEQ ID NO: 1765 - RNA, 19 nt, Artificial Sequence
  Description of Artificial Sequence: Synthetic oligonucleotide
ucauggugcuggugcuguu

SEQ ID NO: 1766 - RNA, 19 nt, Artificial Sequence
  Description of Artificial Sequence: Synthetic oligonucleotide
cauggugcuggugcuguug

SEQ ID NO: 1767 - RNA, 19 nt, Artificial Sequence
  Description of Artificial Sequence: Synthetic oligonucleotide
auggugcuggugcuguugu

SEQ ID NO: 1768 - RNA, 19 nt, Artificial Sequence
  Description of Artificial Sequence: Synthetic oligonucleotide
uggugcuggugcuguugug

SEQ ID NO: 1769 - RNA, 19 nt, Artificial Sequence
  Description of Artificial Sequence: Synthetic oligonucleotide
ggugcuggugcuguugugu

SEQ ID NO: 1770 - RNA, 19 nt, Artificial Sequence
  Description of Artificial Sequence: Synthetic oligonucleotide
gugcuggugcuguugugug

SEQ ID NO: 1771 - RNA, 19 nt, Artificial Sequence
  Description of Artificial Sequence: Synthetic oligonucleotide
ugcuggugcuguugugugu

SEQ ID NO: 1772 - RNA, 19 nt, Artificial Sequence
  Description of Artificial Sequence: Synthetic oligonucleotide
gcuggugcuguugugugua

SEQ ID NO: 1773 - RNA, 19 nt, Artificial Sequence
  Description of Artificial Sequence: Synthetic oligonucleotide
cuggugcuguuguguguag

SEQ ID NO: 1774 - RNA, 19 nt, Artificial Sequence
  Description of Artificial Sequence: Synthetic oligonucleotide
uggugcuguuguguguagg

SEQ ID NO: 1775 - RNA, 19 nt, Artificial Sequence
  Description of Artificial Sequence: Synthetic oligonucleotide
ggugcuguuguguguaggu

SEQ ID NO: 1776 - RNA, 19 nt, Artificial Sequence
  Description of Artificial Sequence: Synthetic oligonucleotide
gugcuguuguguguagguc

SEQ ID NO: 1777 - RNA, 19 nt, Artificial Sequence
  Description of Artificial Sequence: Synthetic oligonucleotide
ugcuguuguguguaggucc

SEQ ID NO: 1778 - RNA, 19 nt, Artificial Sequence
  Description of Artificial Sequence: Synthetic oligonucleotide
gcuguuguguguagguccc

SEQ ID NO: 1779 - RNA, 19 nt, Artificial Sequence
  Description of Artificial Sequence: Synthetic oligonucleotide
cuguuguguguaggucccc

SEQ ID NO: 1780 - RNA, 19 nt, Artificial Sequence
  Description of Artificial Sequence: Synthetic oligonucleotide
uguuguguguagguccccu

SEQ ID NO: 1781 - RNA, 19 nt, Artificial Sequence
  Description of Artificial Sequence: Synthetic oligonucleotide
guuguguguagguccccug

SEQ ID NO: 1782 - RNA, 19 nt, Artificial Sequence
  Description of Artificial Sequence: Synthetic oligonucleotide
uuguguguagguccccugg

SEQ ID NO: 1783 - RNA, 19 nt, Artificial Sequence
  Description of Artificial Sequence: Synthetic oligonucleotide
uguguguagguccccuggg

SEQ ID NO: 1784 - RNA, 19 nt, Artificial Sequence
  Description of Artificial Sequence: Synthetic oligonucleotide
guguguagguccccugggg

SEQ ID NO: 1785 - RNA, 19 nt, Artificial Sequence
  Description of Artificial Sequence: Synthetic oligonucleotide
uguguagguccccugggga

SEQ ID NO: 1786 - RNA, 19 nt, Artificial Sequence
  Description of Artificial Sequence: Synthetic oligonucleotide
guguagguccccuggggac

SEQ ID NO: 1787 - RNA, 19 nt, Artificial Sequence
  Description of Artificial Sequence: Synthetic oligonucleotide
uguagguccccuggggaca

SEQ ID NO: 1788 - RNA, 19 nt, Artificial Sequence
  Description of Artificial Sequence: Synthetic oligonucleotide
guagguccccuggggacac

SEQ ID NO: 1789 - RNA, 19 nt, Artificial Sequence
  Description of Artificial Sequence: Synthetic oligonucleotide
uagguccccuggggacaca

SEQ ID NO: 1790 - RNA, 19 nt, Artificial Sequence
  Description of Artificial Sequence: Synthetic oligonucleotide
agguccccuggggacacaa

SEQ ID NO: 1791 - RNA, 19 nt, Artificial Sequence
  Description of Artificial Sequence: Synthetic oligonucleotide
gguccccuggggacacaag

SEQ ID NO: 1792 - RNA, 19 nt, Artificial Sequence
  Description of Artificial Sequence: Synthetic oligonucleotide
guccccuggggacacaagc

SEQ ID NO: 1793 - RNA, 19 nt, Artificial Sequence
  Description of Artificial Sequence: Synthetic oligonucleotide
uccccuggggacacaagca

SEQ ID NO: 1794 - RNA, 19 nt, Artificial Sequence
  Description of Artificial Sequence: Synthetic oligonucleotide
ccccuggggacacaagcag

SEQ ID NO: 1795 - RNA, 19 nt, Artificial Sequence
  Description of Artificial Sequence: Synthetic oligonucleotide
cccuggggacacaagcagg

SEQ ID NO: 1796 - RNA, 19 nt, Artificial Sequence
  Description of Artificial Sequence: Synthetic oligonucleotide
ccuggggacacaagcaggc

SEQ ID NO: 1797 - RNA, 19 nt, Artificial Sequence
  Description of Artificial Sequence: Synthetic oligonucleotide
cuggggacacaagcaggcg

SEQ ID NO: 1798 - RNA, 19 nt, Artificial Sequence
  Description of Artificial Sequence: Synthetic oligonucleotide
uggggacacaagcaggcgc

SEQ ID NO: 1799 - RNA, 19 nt, Artificial Sequence
  Description of Artificial Sequence: Synthetic oligonucleotide
ggggacacaagcaggcgcc

SEQ ID NO: 1800 - RNA, 19 nt, Artificial Sequence
  Description of Artificial Sequence: Synthetic oligonucleotide
gggacacaagcaggcgcca

SEQ ID NO: 1801 - RNA, 19 nt, Artificial Sequence
  Description of Artificial Sequence: Synthetic oligonucleotide
ggacacaagcaggcgccaa

SEQ ID NO: 1802 - RNA, 19 nt, Artificial Sequence
  Description of Artificial Sequence: Synthetic oligonucleotide
gacacaagcaggcgccaau

SEQ ID NO: 1803 - RNA, 19 nt, Artificial Sequence
  Description of Artificial Sequence: Synthetic oligonucleotide
acacaagcaggcgccaaug

SEQ ID NO: 1804 - RNA, 19 nt, Artificial Sequence
  Description of Artificial Sequence: Synthetic oligonucleotide
cacaagcaggcgccaaugg

SEQ ID NO: 1805 - RNA, 19 nt, Artificial Sequence
  Description of Artificial Sequence: Synthetic oligonucleotide
acaagcaggcgccaauggu

SEQ ID NO: 1806 - RNA, 19 nt, Artificial Sequence
  Description of Artificial Sequence: Synthetic oligonucleotide
caagcaggcgccaauggua

SEQ ID NO: 1807 - RNA, 19 nt, Artificial Sequence
  Description of Artificial Sequence: Synthetic oligonucleotide
aagcaggcgccaaugguau

SEQ ID NO: 1808 - RNA, 19 nt, Artificial Sequence
  Description of Artificial Sequence: Synthetic oligonucleotide
agcaggcgccaaugguauc

SEQ ID NO: 1809 - RNA, 19 nt, Artificial Sequence
  Description of Artificial Sequence: Synthetic oligonucleotide
gcaggcgccaaugguaucu

SEQ ID NO: 1810 - RNA, 19 nt, Artificial Sequence
  Description of Artificial Sequence: Synthetic oligonucleotide
caggcgccaaugguaucug

SEQ ID NO: 1811 - RNA, 19 nt, Artificial Sequence
  Description of Artificial Sequence: Synthetic oligonucleotide
aggcgccaaugguaucugg

SEQ ID NO: 1812 - RNA, 19 nt, Artificial Sequence
  Description of Artificial Sequence: Synthetic oligonucleotide
ggcgccaaugguaucuggg

SEQ ID NO: 1813 - RNA, 19 nt, Artificial Sequence
  Description of Artificial Sequence: Synthetic oligonucleotide
gcgccaaugguaucugggc

SEQ ID NO: 1814 - RNA, 19 nt, Artificial Sequence
  Description of Artificial Sequence: Synthetic oligonucleotide
cgccaaugguaucugggcg

SEQ ID NO: 1815 - RNA, 19 nt, Artificial Sequence
  Description of Artificial Sequence: Synthetic oligonucleotide
gccaaugguaucugggcgg

SEQ ID NO: 1816 - RNA, 19 nt, Artificial Sequence
  Description of Artificial Sequence: Synthetic oligonucleotide
ccaaugguaucugggcgga

SEQ ID NO: 1817 - RNA, 19 nt, Artificial Sequence
  Description of Artificial Sequence: Synthetic oligonucleotide
caaugguaucugggcggag

SEQ ID NO: 1818 - RNA, 19 nt, Artificial Sequence
  Description of Artificial Sequence: Synthetic oligonucleotide
aaugguaucugggcggagc

SEQ ID NO: 1819 - RNA, 19 nt, Artificial Sequence
  Description of Artificial Sequence: Synthetic oligonucleotide
augguaucugggcggagcu

SEQ ID NO: 1820 - RNA, 19 nt, Artificial Sequence
  Description of Artificial Sequence: Synthetic oligonucleotide
ugguaucugggcggagcuc

SEQ ID NO: 1821 - RNA, 19 nt, Artificial Sequence
  Description of Artificial Sequence: Synthetic oligonucleotide
gguaucugggcggagcuca

SEQ ID NO: 1822 - RNA, 19 nt, Artificial Sequence
  Description of Artificial Sequence: Synthetic oligonucleotide
guaucugggcggagcucac

SEQ ID NO: 1823 - RNA, 19 nt, Artificial Sequence
  Description of Artificial Sequence: Synthetic oligonucleotide
uaucugggcggagcucaca

SEQ ID NO: 1824 - RNA, 19 nt, Artificial Sequence
  Description of Artificial Sequence: Synthetic oligonucleotide
aucugggcggagcucacag

SEQ ID NO: 1825 - RNA, 19 nt, Artificial Sequence
  Description of Artificial Sequence: Synthetic oligonucleotide
ucugggcggagcucacaga

SEQ ID NO: 1826 - RNA, 19 nt, Artificial Sequence
  Description of Artificial Sequence: Synthetic oligonucleotide
cugggcggagcucacagag

SEQ ID NO: 1827 - RNA, 19 nt, Artificial Sequence
  Description of Artificial Sequence: Synthetic oligonucleotide
ugggcggagcucacagagu

SEQ ID NO: 1828 - RNA, 19 nt, Artificial Sequence
  Description of Artificial Sequence: Synthetic oligonucleotide
gggcggagcucacagaguu

SEQ ID NO: 1829 - RNA, 19 nt, Artificial Sequence
  Description of Artificial Sequence: Synthetic oligonucleotide
ggcggagcucacagaguuc

SEQ ID NO: 1830 - RNA, 19 nt, Artificial Sequence
  Description of Artificial Sequence: Synthetic oligonucleotide
gcggagcucacagaguucu

SEQ ID NO: 1831 - RNA, 19 nt, Artificial Sequence
  Description of Artificial Sequence: Synthetic oligonucleotide
cggagcucacagaguucuu

SEQ ID NO: 1832 - RNA, 19 nt, Artificial Sequence
  Description of Artificial Sequence: Synthetic oligonucleotide
ggagcucacagaguucuug

SEQ ID NO: 1833 - RNA, 19 nt, Artificial Sequence
  Description of Artificial Sequence: Synthetic oligonucleotide
gagcucacagaguucuugg

SEQ ID NO: 1834 - RNA, 19 nt, Artificial Sequence
  Description of Artificial Sequence: Synthetic oligonucleotide
agcucacagaguucuugga

SEQ ID NO: 1835 - RNA, 19 nt, Artificial Sequence
  Description of Artificial Sequence: Synthetic oligonucleotide
gcucacagaguucuuggaa

SEQ ID NO: 1836 - RNA, 19 nt, Artificial Sequence
  Description of Artificial Sequence: Synthetic oligonucleotide
cucacagaguucuuggaau

SEQ ID NO: 1837 - RNA, 19 nt, Artificial Sequence
  Description of Artificial Sequence: Synthetic oligonucleotide
ucacagaguucuuggaaua

SEQ ID NO: 1838 - RNA, 19 nt, Artificial Sequence
  Description of Artificial Sequence: Synthetic oligonucleotide
cacagaguucuuggaauaa

SEQ ID NO: 1839 - RNA, 19 nt, Artificial Sequence
  Description of Artificial Sequence: Synthetic oligonucleotide
acagaguucuuggaauaaa

SEQ ID NO: 1840 - RNA, 19 nt, Artificial Sequence
  Description of Artificial Sequence: Synthetic oligonucleotide
cagaguucuuggaauaaaa

SEQ ID NO: 1841 - RNA, 19 nt, Artificial Sequence
  Description of Artificial Sequence: Synthetic oligonucleotide
agaguucuuggaauaaaag

SEQ ID NO: 1842 - RNA, 19 nt, Artificial Sequence
  Description of Artificial Sequence: Synthetic oligonucleotide
gaguucuuggaauaaaagc

SEQ ID NO: 1843 - RNA, 19 nt, Artificial Sequence
  Description of Artificial Sequence: Synthetic oligonucleotide
aguucuuggaauaaaagca

SEQ ID NO: 1844 - RNA, 19 nt, Artificial Sequence
  Description of Artificial Sequence: Synthetic oligonucleotide
guucuuggaauaaaagcaa

SEQ ID NO: 1845 - RNA, 19 nt, Artificial Sequence
  Description of Artificial Sequence: Synthetic oligonucleotide
uucuuggaauaaaagcaac

SEQ ID NO: 1846 - RNA, 19 nt, Artificial Sequence
  Description of Artificial Sequence: Synthetic oligonucleotide
ucuuggaauaaaagcaacc

SEQ ID NO: 1847 - RNA, 19 nt, Artificial Sequence
  Description of Artificial Sequence: Synthetic oligonucleotide
cuuggaauaaaagcaaccu

SEQ ID NO: 1848 - RNA, 19 nt, Artificial Sequence
  Description of Artificial Sequence: Synthetic oligonucleotide
uuggaauaaaagcaaccuc

SEQ ID NO: 1849 - RNA, 19 nt, Artificial Sequence
  Description of Artificial Sequence: Synthetic oligonucleotide
uggaauaaaagcaaccuca

SEQ ID NO: 1850 - RNA, 19 nt, Artificial Sequence
  Description of Artificial Sequence: Synthetic oligonucleotide
ggaauaaaagcaaccucag

SEQ ID NO: 1851 - RNA, 19 nt, Artificial Sequence
  Description of Artificial Sequence: Synthetic oligonucleotide
gaauaaaagcaaccucaga

SEQ ID NO: 1852 - RNA, 19 nt, Artificial Sequence
  Description of Artificial Sequence: Synthetic oligonucleotide
aauaaaagcaaccucagaa

SEQ ID NO: 1853 - RNA, 19 nt, Artificial Sequence
  Description of Artificial Sequence: Synthetic oligonucleotide
auaaaagcaaccucagaac

SEQ ID NO: 1854 - RNA, 19 nt, Artificial Sequence
  Description of Artificial Sequence: Synthetic oligonucleotide
uaaaagcaaccucagaaca

SEQ ID NO: 1855 - RNA, 19 nt, Artificial Sequence
  Description of Artificial Sequence: Synthetic oligonucleotide
uccgcucagcucggcuucu

SEQ ID NO: 1856 - RNA, 19 nt, Artificial Sequence
  Description of Artificial Sequence: Synthetic oligonucleotide
auccgcucagcucggcuuc

SEQ ID NO: 1857 - RNA, 19 nt, Artificial Sequence
  Description of Artificial Sequence: Synthetic oligonucleotide
gauccgcucagcucggcuu

SEQ ID NO: 1858 - RNA, 19 nt, Artificial Sequence
  Description of Artificial Sequence: Synthetic oligonucleotide
ggauccgcucagcucggcu

SEQ ID NO: 1859 - RNA, 19 nt, Artificial Sequence
  Description of Artificial Sequence: Synthetic oligonucleotide
aggauccgcucagcucggc

SEQ ID NO: 1860 - RNA, 19 nt, Artificial Sequence
  Description of Artificial Sequence: Synthetic oligonucleotide
gaggauccgcucagcucgg

SEQ ID NO: 1861 - RNA, 19 nt, Artificial Sequence
  Description of Artificial Sequence: Synthetic oligonucleotide
ugaggauccgcucagcucg

SEQ ID NO: 1862 - RNA, 19 nt, Artificial Sequence
  Description of Artificial Sequence: Synthetic oligonucleotide
gugaggauccgcucagcuc

SEQ ID NO: 1863 - RNA, 19 nt, Artificial Sequence
  Description of Artificial Sequence: Synthetic oligonucleotide
ugugaggauccgcucagcu

SEQ ID NO: 1864 - RNA, 19 nt, Artificial Sequence
  Description of Artificial Sequence: Synthetic oligonucleotide
gugugaggauccgcucagc

SEQ ID NO: 1865 - RNA, 19 nt, Artificial Sequence
  Description of Artificial Sequence: Synthetic oligonucleotide
cgugugaggauccgcucag

SEQ ID NO: 1866 - RNA, 19 nt, Artificial Sequence
  Description of Artificial Sequence: Synthetic oligonucleotide
ucgugugaggauccgcuca

SEQ ID NO: 1867 - RNA, 19 nt, Artificial Sequence
  Description of Artificial Sequence: Synthetic oligonucleotide
gucgugugaggauccgcuc

SEQ ID NO: 1868 - RNA, 19 nt, Artificial Sequence
  Description of Artificial Sequence: Synthetic oligonucleotide
agucgugugaggauccgcu

SEQ ID NO: 1869 - RNA, 19 nt, Artificial Sequence
  Description of Artificial Sequence: Synthetic oligonucleotide
cagucgugugaggauccgc

SEQ ID NO: 1870 - RNA, 19 nt, Artificial Sequence
  Description of Artificial Sequence: Synthetic oligonucleotide
acagucgugugaggauccg

SEQ ID NO: 1871 - RNA, 19 nt, Artificial Sequence
  Description of Artificial Sequence: Synthetic oligonucleotide
cacagucgugugaggaucc

SEQ ID NO: 1872 - RNA, 19 nt, Artificial Sequence
  Description of Artificial Sequence: Synthetic oligonucleotide
ucacagucgugugaggauc

SEQ ID NO: 1873 - RNA, 19 nt, Artificial Sequence
  Description of Artificial Sequence: Synthetic oligonucleotide
aucacagucgugugaggau

SEQ ID NO: 1874 - RNA, 19 nt, Artificial Sequence
  Description of Artificial Sequence: Synthetic oligonucleotide
gaucacagucgugugagga

SEQ ID NO: 1875 - RNA, 19 nt, Artificial Sequence
  Description of Artificial Sequence: Synthetic oligonucleotide
ggaucacagucgugugagg

SEQ ID NO: 1876 - RNA, 19 nt, Artificial Sequence
  Description of Artificial Sequence: Synthetic oligonucleotide
cggaucacagucgugugag

SEQ ID NO: 1877 - RNA, 19 nt, Artificial Sequence
  Description of Artificial Sequence: Synthetic oligonucleotide
ucggaucacagucguguga

SEQ ID NO: 1878 - RNA, 19 nt, Artificial Sequence
  Description of Artificial Sequence: Synthetic oligonucleotide
aucggaucacagucgugug

SEQ ID NO: 1879 - RNA, 19 nt, Artificial Sequence
  Description of Artificial Sequence: Synthetic oligonucleotide
aaucggaucacagucgugu

SEQ ID NO: 1880 - RNA, 19 nt, Artificial Sequence
  Description of Artificial Sequence: Synthetic oligonucleotide
gaaucggaucacagucgug

SEQ ID NO: 1881 - RNA, 19 nt, Artificial Sequence
  Description of Artificial Sequence: Synthetic oligonucleotide
agaaucggaucacagucgu

SEQ ID NO: 1882 - RNA, 19 nt, Artificial Sequence
  Description of Artificial Sequence: Synthetic oligonucleotide
aagaaucggaucacagucg

SEQ ID NO: 1883 - RNA, 19 nt, Artificial Sequence
  Description of Artificial Sequence: Synthetic oligonucleotide
aaagaaucggaucacaguc

SEQ ID NO: 1884 - RNA, 19 nt, Artificial Sequence
  Description of Artificial Sequence: Synthetic oligonucleotide
gaaagaaucggaucacagu

SEQ ID NO: 1885 - RNA, 19 nt, Artificial Sequence
  Description of Artificial Sequence: Synthetic oligonucleotide
ggaaagaaucggaucacag

SEQ ID NO: 1886 - RNA, 19 nt, Artificial Sequence
  Description of Artificial Sequence: Synthetic oligonucleotide
uggaaagaaucggaucaca

SEQ ID NO: 1887 - RNA, 19 nt, Artificial Sequence
  Description of Artificial Sequence: Synthetic oligonucleotide
cuggaaagaaucggaucac

SEQ ID NO: 1888 - RNA, 19 nt, Artificial Sequence
  Description of Artificial Sequence: Synthetic oligonucleotide
gcuggaaagaaucggauca

SEQ ID NO: 1889 - RNA, 19 nt, Artificial Sequence
  Description of Artificial Sequence: Synthetic oligonucleotide
cgcuggaaagaaucggauc

SEQ ID NO: 1890 - RNA, 19 nt, Artificial Sequence
  Description of Artificial Sequence: Synthetic oligonucleotide
ccgcuggaaagaaucggau

SEQ ID NO: 1891 - RNA, 19 nt, Artificial Sequence
  Description of Artificial Sequence: Synthetic oligonucleotide
gccgcuggaaagaaucgga

SEQ ID NO: 1892 - RNA, 19 nt, Artificial Sequence
  Description of Artificial Sequence: Synthetic oligonucleotide
agccgcuggaaagaaucgg

SEQ ID NO: 1893 - RNA, 19 nt, Artificial Sequence
  Description of Artificial Sequence: Synthetic oligonucleotide
aagccgcuggaaagaaucg

SEQ ID NO: 1894 - RNA, 19 nt, Artificial Sequence
  Description of Artificial Sequence: Synthetic oligonucleotide
gaagccgcuggaaagaauc

SEQ ID NO: 1895 - RNA, 19 nt, Artificial Sequence
  Description of Artificial Sequence: Synthetic oligonucleotide
agaagccgcuggaaagaau

SEQ ID NO: 1896 - RNA, 19 nt, Artificial Sequence
  Description of Artificial Sequence: Synthetic oligonucleotide
cagaagccgcuggaaagaa

SEQ ID NO: 1897 - RNA, 19 nt, Artificial Sequence
  Description of Artificial Sequence: Synthetic oligonucleotide
gcagaagccgcuggaaaga

SEQ ID NO: 1898 - RNA, 19 nt, Artificial Sequence
  Description of Artificial Sequence: Synthetic oligonucleotide
ugcagaagccgcuggaaag

SEQ ID NO: 1899 - RNA, 19 nt, Artificial Sequence
  Description of Artificial Sequence: Synthetic oligonucleotide
uugcagaagccgcuggaaa

SEQ ID NO: 1900 - RNA, 19 nt, Artificial Sequence
  Description of Artificial Sequence: Synthetic oligonucleotide
guugcagaagccgcuggaa

SEQ ID NO: 1901 - RNA, 19 nt, Artificial Sequence
  Description of Artificial Sequence: Synthetic oligonucleotide
gguugcagaagccgcugga

SEQ ID NO: 1902 - RNA, 19 nt, Artificial Sequence
  Description of Artificial Sequence: Synthetic oligonucleotide
ugguugcagaagccgcugg

SEQ ID NO: 1903 - RNA, 19 nt, Artificial Sequence
  Description of Artificial Sequence: Synthetic oligonucleotide
uugguugcagaagccgcug

SEQ ID NO: 1904 - RNA, 19 nt, Artificial Sequence
  Description of Artificial Sequence: Synthetic oligonucleotide
cuugguugcagaagccgcu

SEQ ID NO: 1905 - RNA, 19 nt, Artificial Sequence
  Description of Artificial Sequence: Synthetic oligonucleotide
gcuugguugcagaagccgc

SEQ ID NO: 1906 - RNA, 19 nt, Artificial Sequence
  Description of Artificial Sequence: Synthetic oligonucleotide
cgcuugguugcagaagccg

SEQ ID NO: 1907 - RNA, 19 nt, Artificial Sequence
  Description of Artificial Sequence: Synthetic oligonucleotide
ccgcuugguugcagaagcc

SEQ ID NO: 1908 - RNA, 19 nt, Artificial Sequence
  Description of Artificial Sequence: Synthetic oligonucleotide
cccgcuugguugcagaagc

SEQ ID NO: 1909 - RNA, 19 nt, Artificial Sequence
  Description of Artificial Sequence: Synthetic oligonucleotide
acccgcuugguugcagaag

SEQ ID NO: 1910 - RNA, 19 nt, Artificial Sequence
  Description of Artificial Sequence: Synthetic oligonucleotide
gacccgcuugguugcagaa

SEQ ID NO: 1911 - RNA, 19 nt, Artificial Sequence
  Description of Artificial Sequence: Synthetic oligonucleotide
agacccgcuugguugcaga

SEQ ID NO: 1912 - RNA, 19 nt, Artificial Sequence
  Description of Artificial Sequence: Synthetic oligonucleotide
aagacccgcuugguugcag

SEQ ID NO: 1913 - RNA, 19 nt, Artificial Sequence
  Description of Artificial Sequence: Synthetic oligonucleotide
uaagacccgcuugguugca

SEQ ID NO: 1914 - RNA, 19 nt, Artificial Sequence
  Description of Artificial Sequence: Synthetic oligonucleotide
guaagacccgcuugguugc

SEQ ID NO: 1915 - RNA, 19 nt, Artificial Sequence
  Description of Artificial Sequence: Synthetic oligonucleotide
gguaagacccgcuugguug

SEQ ID NO: 1916 - RNA, 19 nt, Artificial Sequence
  Description of Artificial Sequence: Synthetic oligonucleotide
ggguaagacccgcuugguu

SEQ ID NO: 1917 - RNA, 19 nt, Artificial Sequence
  Description of Artificial Sequence: Synthetic oligonucleotide
gggguaagacccgcuuggu

SEQ ID NO: 1918 - RNA, 19 nt, Artificial Sequence
  Description of Artificial Sequence: Synthetic oligonucleotide
ggggguaagacccgcuugg

SEQ ID NO: 1919 - RNA, 19 nt, Artificial Sequence
  Description of Artificial Sequence: Synthetic oligonucleotide
cggggguaagacccgcuug

SEQ ID NO: 1920 - RNA, 19 nt, Artificial Sequence
  Description of Artificial Sequence: Synthetic oligonucleotide
ccggggguaagacccgcuu

SEQ ID NO: 1921 - RNA, 19 nt, Artificial Sequence
  Description of Artificial Sequence: Synthetic oligonucleotide
accggggguaagacccgcu

SEQ ID NO: 1922 - RNA, 19 nt, Artificial Sequence
  Description of Artificial Sequence: Synthetic oligonucleotide
gaccggggguaagacccgc

SEQ ID NO: 1923 - RNA, 19 nt, Artificial Sequence
  Description of Artificial Sequence: Synthetic oligonucleotide
ggaccggggguaagacccg

SEQ ID NO: 1924 - RNA, 19 nt, Artificial Sequence
  Description of Artificial Sequence: Synthetic oligonucleotide
aggaccggggguaagaccc

SEQ ID NO: 1925 - RNA, 19 nt, Artificial Sequence
  Description of Artificial Sequence: Synthetic oligonucleotide
gaggaccggggguaagacc

SEQ ID NO: 1926 - RNA, 19 nt, Artificial Sequence
  Description of Artificial Sequence: Synthetic oligonucleotide
ggaggaccggggguaagac

SEQ ID NO: 1927 - RNA, 19 nt, Artificial Sequence
  Description of Artificial Sequence: Synthetic oligonucleotide
cggaggaccggggguaaga

SEQ ID NO: 1928 - RNA, 19 nt, Artificial Sequence
  Description of Artificial Sequence: Synthetic oligonucleotide
gcggaggaccggggguaag

SEQ ID NO: 1929 - RNA, 19 nt, Artificial Sequence
  Description of Artificial Sequence: Synthetic oligonucleotide
cgcggaggaccggggguaa

SEQ ID NO: 1930 - RNA, 19 nt, Artificial Sequence
  Description of Artificial Sequence: Synthetic oligonucleotide
acgcggaggaccgggggua

SEQ ID NO: 1931 - RNA, 19 nt, Artificial Sequence
  Description of Artificial Sequence: Synthetic oligonucleotide
gacgcggaggaccgggggu

SEQ ID NO: 1932 - RNA, 19 nt, Artificial Sequence
  Description of Artificial Sequence: Synthetic oligonucleotide
agacgcggaggaccggggg

SEQ ID NO: 1933 - RNA, 19 nt, Artificial Sequence
  Description of Artificial Sequence: Synthetic oligonucleotide
gagacgcggaggaccgggg

SEQ ID NO: 1934 - RNA, 19 nt, Artificial Sequence
  Description of Artificial Sequence: Synthetic oligonucleotide
ggagacgcggaggaccggg

SEQ ID NO: 1935 - RNA, 19 nt, Artificial Sequence
  Description of Artificial Sequence: Synthetic oligonucleotide
uggagacgcggaggaccgg

SEQ ID NO: 1936 - RNA, 19 nt, Artificial Sequence
  Description of Artificial Sequence: Synthetic oligonucleotide
cuggagacgcggaggaccg

SEQ ID NO: 1937 - RNA, 19 nt, Artificial Sequence
  Description of Artificial Sequence: Synthetic oligonucleotide
acuggagacgcggaggacc

SEQ ID NO: 1938 - RNA, 19 nt, Artificial Sequence
  Description of Artificial Sequence: Synthetic oligonucleotide
gacuggagacgcggaggac

SEQ ID NO: 1939 - RNA, 19 nt, Artificial Sequence
  Description of Artificial Sequence: Synthetic oligonucleotide
ggacuggagacgcggagga

SEQ ID NO: 1940 - RNA, 19 nt, Artificial Sequence
  Description of Artificial Sequence: Synthetic oligonucleotide
aggacuggagacgcggagg

SEQ ID NO: 1941 - RNA, 19 nt, Artificial Sequence
  Description of Artificial Sequence: Synthetic oligonucleotide
gaggacuggagacgcggag

SEQ ID NO: 1942 - RNA, 19 nt, Artificial Sequence
  Description of Artificial Sequence: Synthetic oligonucleotide
cgaggacuggagacgcgga

SEQ ID NO: 1943 - RNA, 19 nt, Artificial Sequence
  Description of Artificial Sequence: Synthetic oligonucleotide
gcgaggacuggagacgcgg

SEQ ID NO: 1944 - RNA, 19 nt, Artificial Sequence
  Description of Artificial Sequence: Synthetic oligonucleotide
ugcgaggacuggagacgcg

SEQ ID NO: 1945 - RNA, 19 nt, Artificial Sequence
  Description of Artificial Sequence: Synthetic oligonucleotide
gugcgaggacuggagacgc

SEQ ID NO: 1946 - RNA, 19 nt, Artificial Sequence
  Description of Artificial Sequence: Synthetic oligonucleotide
ggugcgaggacuggagacg

SEQ ID NO: 1947 - RNA, 19 nt, Artificial Sequence
  Description of Artificial Sequence: Synthetic oligonucleotide
aggugcgaggacuggagac

SEQ ID NO: 1948 - RNA, 19 nt, Artificial Sequence
  Description of Artificial Sequence: Synthetic oligonucleotide
caggugcgaggacuggaga

SEQ ID NO: 1949 - RNA, 19 nt, Artificial Sequence
  Description of Artificial Sequence: Synthetic oligonucleotide
ccaggugcgaggacuggag

SEQ ID NO: 1950 - RNA, 19 nt, Artificial Sequence
  Description of Artificial Sequence: Synthetic oligonucleotide
uccaggugcgaggacugga

SEQ ID NO: 1951 - RNA, 19 nt, Artificial Sequence
  Description of Artificial Sequence: Synthetic oligonucleotide
uuccaggugcgaggacugg

SEQ ID NO: 1952 - RNA, 19 nt, Artificial Sequence
  Description of Artificial Sequence: Synthetic oligonucleotide
guuccaggugcgaggacug

SEQ ID NO: 1953 - RNA, 19 nt, Artificial Sequence
  Description of Artificial Sequence: Synthetic oligonucleotide
gguuccaggugcgaggacu

SEQ ID NO: 1954 - RNA, 19 nt, Artificial Sequence
  Description of Artificial Sequence: Synthetic oligonucleotide
ggguuccaggugcgaggac

SEQ ID NO: 1955 - RNA, 19 nt, Artificial Sequence
  Description of Artificial Sequence: Synthetic oligonucleotide
gggguuccaggugcgagga

SEQ ID NO: 1956 - RNA, 19 nt, Artificial Sequence
  Description of Artificial Sequence: Synthetic oligonucleotide
ugggguuccaggugcgagg

SEQ ID NO: 1957 - RNA, 19 nt, Artificial Sequence
  Description of Artificial Sequence: Synthetic oligonucleotide
uugggguuccaggugcgag

SEQ ID NO: 1958 - RNA, 19 nt, Artificial Sequence
  Description of Artificial Sequence: Synthetic oligonucleotide
guugggguuccaggugcga

SEQ ID NO: 1959 - RNA, 19 nt, Artificial Sequence
  Description of Artificial Sequence: Synthetic oligonucleotide
cguugggguuccaggugcg

SEQ ID NO: 1960 - RNA, 19 nt, Artificial Sequence
  Description of Artificial Sequence: Synthetic oligonucleotide
acguugggguuccaggugc

SEQ ID NO: 1961 - RNA, 19 nt, Artificial Sequence
  Description of Artificial Sequence: Synthetic oligonucleotide
gacguugggguuccaggug

SEQ ID NO: 1962 - RNA, 19 nt, Artificial Sequence
  Description of Artificial Sequence: Synthetic oligonucleotide
ggacguugggguuccaggu

SEQ ID NO: 1963 - RNA, 19 nt, Artificial Sequence
  Description of Artificial Sequence: Synthetic oligonucleotide
gggacguugggguuccagg

SEQ ID NO: 1964 - RNA, 19 nt, Artificial Sequence
  Description of Artificial Sequence: Synthetic oligonucleotide
ggggacguugggguuccag

SEQ ID NO: 1965 - RNA, 19 nt, Artificial Sequence
  Description of Artificial Sequence: Synthetic oligonucleotide
cggggacguugggguucca

SEQ ID NO: 1966 - RNA, 19 nt, Artificial Sequence
  Description of Artificial Sequence: Synthetic oligonucleotide
ucggggacguugggguucc

SEQ ID NO: 1967 - RNA, 19 nt, Artificial Sequence
  Description of Artificial Sequence: Synthetic oligonucleotide
cucggggacguugggguuc

SEQ ID NO: 1968 - RNA, 19 nt, Artificial Sequence
  Description of Artificial Sequence: Synthetic oligonucleotide
ucucggggacguugggguu

SEQ ID NO: 1969 - RNA, 19 nt, Artificial Sequence
  Description of Artificial Sequence: Synthetic oligonucleotide
cucucggggacguuggggu

SEQ ID NO: 1970 - RNA, 19 nt, Artificial Sequence
  Description of Artificial Sequence: Synthetic oligonucleotide
acucucggggacguugggg

SEQ ID NO: 1971 - RNA, 19 nt, Artificial Sequence
  Description of Artificial Sequence: Synthetic oligonucleotide
gacucucggggacguuggg

SEQ ID NO: 1972 - RNA, 19 nt, Artificial Sequence
  Description of Artificial Sequence: Synthetic oligonucleotide
ggacucucggggacguugg

SEQ ID NO: 1973 - RNA, 19 nt, Artificial Sequence
  Description of Artificial Sequence: Synthetic oligonucleotide
gggacucucggggacguug

SEQ ID NO: 1974 - RNA, 19 nt, Artificial Sequence
  Description of Artificial Sequence: Synthetic oligonucleotide
ggggacucucggggacguu

SEQ ID NO: 1975 - RNA, 19 nt, Artificial Sequence
  Description of Artificial Sequence: Synthetic oligonucleotide
cggggacucucggggacgu

SEQ ID NO: 1976 - RNA, 19 nt, Artificial Sequence
  Description of Artificial Sequence: Synthetic oligonucleotide
ucggggacucucggggacg

SEQ ID NO: 1977 - RNA, 19 nt, Artificial Sequence
  Description of Artificial Sequence: Synthetic oligonucleotide
uucggggacucucggggac

SEQ ID NO: 1978 - RNA, 19 nt, Artificial Sequence
  Description of Artificial Sequence: Synthetic oligonucleotide
auucggggacucucgggga

SEQ ID NO: 1979 - RNA, 19 nt, Artificial Sequence
  Description of Artificial Sequence: Synthetic oligonucleotide
gauucggggacucucgggg

SEQ ID NO: 1980 - RNA, 19 nt, Artificial Sequence
  Description of Artificial Sequence: Synthetic oligonucleotide
ggauucggggacucucggg

SEQ ID NO: 1981 - RNA, 19 nt, Artificial Sequence
  Description of Artificial Sequence: Synthetic oligonucleotide
gggauucggggacucucgg

SEQ ID NO: 1982 - RNA, 19 nt, Artificial Sequence
  Description of Artificial Sequence: Synthetic oligonucleotide
ggggauucggggacucucg

SEQ ID NO: 1983 - RNA, 19 nt, Artificial Sequence
  Description of Artificial Sequence: Synthetic oligonucleotide
cggggauucggggacucuc

SEQ ID NO: 1984 - RNA, 19 nt, Artificial Sequence
  Description of Artificial Sequence: Synthetic oligonucleotide
gcggggauucggggacucu

SEQ ID NO: 1985 - RNA, 19 nt, Artificial Sequence
  Description of Artificial Sequence: Synthetic oligonucleotide
agcggggauucggggacuc

SEQ ID NO: 1986 - RNA, 19 nt, Artificial Sequence
  Description of Artificial Sequence: Synthetic oligonucleotide
gagcggggauucggggacu

SEQ ID NO: 1987 - RNA, 19 nt, Artificial Sequence
  Description of Artificial Sequence: Synthetic oligonucleotide
ggagcggggauucggggac

SEQ ID NO: 1988 - RNA, 19 nt, Artificial Sequence
  Description of Artificial Sequence: Synthetic oligonucleotide
gggagcggggauucgggga

SEQ ID NO: 1989 - RNA, 19 nt, Artificial Sequence
  Description of Artificial Sequence: Synthetic oligonucleotide
ugggagcggggauucgggg

SEQ ID NO: 1990 - RNA, 19 nt, Artificial Sequence
  Description of Artificial Sequence: Synthetic oligonucleotide
cugggagcggggauucggg

SEQ ID NO: 1991 - RNA, 19 nt, Artificial Sequence
  Description of Artificial Sequence: Synthetic oligonucleotide
ccugggagcggggauucgg

SEQ ID NO: 1992 - RNA, 19 nt, Artificial Sequence
  Description of Artificial Sequence: Synthetic oligonucleotide
gccugggagcggggauucg

SEQ ID NO: 1993 - RNA, 19 nt, Artificial Sequence
  Description of Artificial Sequence: Synthetic oligonucleotide
agccugggagcggggauuc

SEQ ID NO: 1994 - RNA, 19 nt, Artificial Sequence
  Description of Artificial Sequence: Synthetic oligonucleotide
uagccugggagcggggauu

SEQ ID NO: 1995 - RNA, 19 nt, Artificial Sequence
  Description of Artificial Sequence: Synthetic oligonucleotide
guagccugggagcggggau

SEQ ID NO: 1996 - RNA, 19 nt, Artificial Sequence
  Description of Artificial Sequence: Synthetic oligonucleotide
gguagccugggagcgggga

SEQ ID NO: 1997 - RNA, 19 nt, Artificial Sequence
  Description of Artificial Sequence: Synthetic oligonucleotide
agguagccugggagcgggg

SEQ ID NO: 1998 - RNA, 19 nt, Artificial Sequence
  Description of Artificial Sequence: Synthetic oligonucleotide
uagguagccugggagcggg

SEQ ID NO: 1999 - RNA, 19 nt, Artificial Sequence
  Description of Artificial Sequence: Synthetic oligonucleotide
uuagguagccugggagcgg

SEQ ID NO: 2000 - RNA, 19 nt, Artificial Sequence
  Description of Artificial Sequence: Synthetic oligonucleotide
cuuagguagccugggagcg

SEQ ID NO: 2001 - RNA, 19 nt, Artificial Sequence
  Description of Artificial Sequence: Synthetic oligonucleotide
ucuuagguagccugggagc

SEQ ID NO: 2002 - RNA, 19 nt, Artificial Sequence
  Description of Artificial Sequence: Synthetic oligonucleotide
cucuuagguagccugggag

SEQ ID NO: 2003 - RNA, 19 nt, Artificial Sequence
  Description of Artificial Sequence: Synthetic oligonucleotide
ccucuuagguagccuggga

SEQ ID NO: 2004 - RNA, 19 nt, Artificial Sequence
  Description of Artificial Sequence: Synthetic oligonucleotide
uccucuuagguagccuggg

SEQ ID NO: 2005 - RNA, 19 nt, Artificial Sequence
  Description of Artificial Sequence: Synthetic oligonucleotide
auccucuuagguagccugg

SEQ ID NO: 2006 - RNA, 19 nt, Artificial Sequence
  Description of Artificial Sequence: Synthetic oligonucleotide
cauccucuuagguagccug

SEQ ID NO: 2007 - RNA, 19 nt, Artificial Sequence
  Description of Artificial Sequence: Synthetic oligonucleotide
ucauccucuuagguagccu

SEQ ID NO: 2008 - RNA, 19 nt, Artificial Sequence
  Description of Artificial Sequence: Synthetic oligonucleotide
cucauccucuuagguagcc

SEQ ID NO: 2009 - RNA, 19 nt, Artificial Sequence
  Description of Artificial Sequence: Synthetic oligonucleotide
gcucauccucuuagguagc

SEQ ID NO: 2010 - RNA, 19 nt, Artificial Sequence
  Description of Artificial Sequence: Synthetic oligonucleotide
cgcucauccucuuagguag

SEQ ID NO: 2011 - RNA, 19 nt, Artificial Sequence
  Description of Artificial Sequence: Synthetic oligonucleotide
ccgcucauccucuuaggua

SEQ ID NO: 2012 - RNA, 19 nt, Artificial Sequence
  Description of Artificial Sequence: Synthetic oligonucleotide
accgcucauccucuuaggu

SEQ ID NO: 2013 - RNA, 19 nt, Artificial Sequence
  Description of Artificial Sequence: Synthetic oligonucleotide
caccgcucauccucuuagg

SEQ ID NO: 2014 - RNA, 19 nt, Artificial Sequence
  Description of Artificial Sequence: Synthetic oligonucleotide
gcaccgcucauccucuuag

SEQ ID NO: 2015 - RNA, 19 nt, Artificial Sequence
  Description of Artificial Sequence: Synthetic oligonucleotide
agcaccgcucauccucuua

SEQ ID NO: 2016 - RNA, 19 nt, Artificial Sequence
  Description of Artificial Sequence: Synthetic oligonucleotide
gagcaccgcucauccucuu

SEQ ID NO: 2017 - RNA, 19 nt, Artificial Sequence
  Description of Artificial Sequence: Synthetic oligonucleotide
ggagcaccgcucauccucu

SEQ ID NO: 2018 - RNA, 19 nt, Artificial Sequence
  Description of Artificial Sequence: Synthetic oligonucleotide
cggagcaccgcucauccuc

SEQ ID NO: 2019 - RNA, 19 nt, Artificial Sequence
  Description of Artificial Sequence: Synthetic oligonucleotide
ucggagcaccgcucauccu

SEQ ID NO: 2020 - RNA, 19 nt, Artificial Sequence
  Description of Artificial Sequence: Synthetic oligonucleotide
gucggagcaccgcucaucc

SEQ ID NO: 2021 - RNA, 19 nt, Artificial Sequence
  Description of Artificial Sequence: Synthetic oligonucleotide
cgucggagcaccgcucauc

SEQ ID NO: 2022 - RNA, 19 nt, Artificial Sequence
  Description of Artificial Sequence: Synthetic oligonucleotide
ccgucggagcaccgcucau

SEQ ID NO: 2023 - RNA, 19 nt, Artificial Sequence
  Description of Artificial Sequence: Synthetic oligonucleotide
gccgucggagcaccgcuca

SEQ ID NO: 2024 - RNA, 19 nt, Artificial Sequence
  Description of Artificial Sequence: Synthetic oligonucleotide
ggccgucggagcaccgcuc

SEQ ID NO: 2025 - RNA, 19 nt, Artificial Sequence
  Description of Artificial Sequence: Synthetic oligonucleotide
cggccgucggagcaccgcu

SEQ ID NO: 2026 - RNA, 19 nt, Artificial Sequence
  Description of Artificial Sequence: Synthetic oligonucleotide
ccggccgucggagcaccgc

SEQ ID NO: 2027 - RNA, 19 nt, Artificial Sequence
  Description of Artificial Sequence: Synthetic oligonucleotide
cccggccgucggagcaccg

SEQ ID NO: 2028 - RNA, 19 nt, Artificial Sequence
  Description of Artificial Sequence: Synthetic oligonucleotide
ccccggccgucggagcacc

SEQ ID NO: 2029 - RNA, 19 nt, Artificial Sequence
  Description of Artificial Sequence: Synthetic oligonucleotide
gccccggccgucggagcac

SEQ ID NO: 2030 - RNA, 19 nt, Artificial Sequence
  Description of Artificial Sequence: Synthetic oligonucleotide
ugccccggccgucggagca

SEQ ID NO: 2031 - RNA, 19 nt, Artificial Sequence
  Description of Artificial Sequence: Synthetic oligonucleotide
cugccccggccgucggagc

SEQ ID NO: 2032 - RNA, 19 nt, Artificial Sequence
  Description of Artificial Sequence: Synthetic oligonucleotide
gcugccccggccgucggag

SEQ ID NO: 2033 - RNA, 19 nt, Artificial Sequence
  Description of Artificial Sequence: Synthetic oligonucleotide
ggcugccccggccgucgga

SEQ ID NO: 2034 - RNA, 19 nt, Artificial Sequence
  Description of Artificial Sequence: Synthetic oligonucleotide
gggcugccccggccgucgg

SEQ ID NO: 2035 - RNA, 19 nt, Artificial Sequence
  Description of Artificial Sequence: Synthetic oligonucleotide
agggcugccccggccgucg

SEQ ID NO: 2036 - RNA, 19 nt, Artificial Sequence
  Description of Artificial Sequence: Synthetic oligonucleotide
cagggcugccccggccguc

SEQ ID NO: 2037 - RNA, 19 nt, Artificial Sequence
  Description of Artificial Sequence: Synthetic oligonucleotide
ucagggcugccccggccgu

SEQ ID NO: 2038 - RNA, 19 nt, Artificial Sequence
  Description of Artificial Sequence: Synthetic oligonucleotide
aucagggcugccccggccg

SEQ ID NO: 2039 - RNA, 19 nt, Artificial Sequence
  Description of Artificial Sequence: Synthetic oligonucleotide
caucagggcugccccggcc

SEQ ID NO: 2040 - RNA, 19 nt, Artificial Sequence
  Description of Artificial Sequence: Synthetic oligonucleotide
gcaucagggcugccccggc

SEQ ID NO: 2041 - RNA, 19 nt, Artificial Sequence
  Description of Artificial Sequence: Synthetic oligonucleotide
agcaucagggcugccccgg

SEQ ID NO: 2042 - RNA, 19 nt, Artificial Sequence
  Description of Artificial Sequence: Synthetic oligonucleotide
gagcaucagggcugccccg

SEQ ID NO: 2043 - RNA, 19 nt, Artificial Sequence
  Description of Artificial Sequence: Synthetic oligonucleotide
agagcaucagggcugcccc

SEQ ID NO: 2044 - RNA, 19 nt, Artificial Sequence
  Description of Artificial Sequence: Synthetic oligonucleotide
cagagcaucagggcugccc

SEQ ID NO: 2045 - RNA, 19 nt, Artificial Sequence
  Description of Artificial Sequence: Synthetic oligonucleotide
gcagagcaucagggcugcc

SEQ ID NO: 2046 - RNA, 19 nt, Artificial Sequence
  Description of Artificial Sequence: Synthetic oligonucleotide
cgcagagcaucagggcugc

SEQ ID NO: 2047 - RNA, 19 nt, Artificial Sequence
  Description of Artificial Sequence: Synthetic oligonucleotide
gcgcagagcaucagggcug

SEQ ID NO: 2048 - RNA, 19 nt, Artificial Sequence
  Description of Artificial Sequence: Synthetic oligonucleotide
ggcgcagagcaucagggcu

SEQ ID NO: 2049 - RNA, 19 nt, Artificial Sequence
  Description of Artificial Sequence: Synthetic oligonucleotide
cggcgcagagcaucagggc

SEQ ID NO: 2050 - RNA, 19 nt, Artificial Sequence
  Description of Artificial Sequence: Synthetic oligonucleotide
gcggcgcagagcaucaggg

SEQ ID NO: 2051 - RNA, 19 nt, Artificial Sequence
  Description of Artificial Sequence: Synthetic oligonucleotide
ggcggcgcagagcaucagg

SEQ ID NO: 2052 - RNA, 19 nt, Artificial Sequence
  Description of Artificial Sequence: Synthetic oligonucleotide
uggcggcgcagagcaucag

SEQ ID NO: 2053 - RNA, 19 nt, Artificial Sequence
  Description of Artificial Sequence: Synthetic oligonucleotide
guggcggcgcagagcauca

SEQ ID NO: 2054 - RNA, 19 nt, Artificial Sequence
  Description of Artificial Sequence: Synthetic oligonucleotide
gguggcggcgcagagcauc

SEQ ID NO: 2055 - RNA, 19 nt, Artificial Sequence
  Description of Artificial Sequence: Synthetic oligonucleotide
cgguggcggcgcagagcau

SEQ ID NO: 2056 - RNA, 19 nt, Artificial Sequence
  Description of Artificial Sequence: Synthetic oligonucleotide
gcgguggcggcgcagagca

SEQ ID NO: 2057 - RNA, 19 nt, Artificial Sequence
  Description of Artificial Sequence: Synthetic oligonucleotide
ggcgguggcggcgcagagc

SEQ ID NO: 2058 - RNA, 19 nt, Artificial Sequence
  Description of Artificial Sequence: Synthetic oligonucleotide
cggcgguggcggcgcagag

SEQ ID NO: 2059 - RNA, 19 nt, Artificial Sequence
  Description of Artificial Sequence: Synthetic oligonucleotide
acggcgguggcggcgcaga

SEQ ID NO: 2060 - RNA, 19 nt, Artificial Sequence
  Description of Artificial Sequence: Synthetic oligonucleotide
cacggcgguggcggcgcag

SEQ ID NO: 2061 - RNA, 19 nt, Artificial Sequence
  Description of Artificial Sequence: Synthetic oligonucleotide
gcacggcgguggcggcgca

SEQ ID NO: 2062 - RNA, 19 nt, Artificial Sequence
  Description of Artificial Sequence: Synthetic oligonucleotide
agcacggcgguggcggcgc

SEQ ID NO: 2063 - RNA, 19 nt, Artificial Sequence
  Description of Artificial Sequence: Synthetic oligonucleotide
uagcacggcgguggcggcg

SEQ ID NO: 2064 - RNA, 19 nt, Artificial Sequence
  Description of Artificial Sequence: Synthetic oligonucleotide
guagcacggcgguggcggc

SEQ ID NO: 2065 - RNA, 19 nt, Artificial Sequence
  Description of Artificial Sequence: Synthetic oligonucleotide
aguagcacggcgguggcgg

SEQ ID NO: 2066 - RNA, 19 nt, Artificial Sequence
  Description of Artificial Sequence: Synthetic oligonucleotide
caguagcacggcgguggcg

SEQ ID NO: 2067 - RNA, 19 nt, Artificial Sequence
  Description of Artificial Sequence: Synthetic oligonucleotide
ucaguagcacggcgguggc

SEQ ID NO: 2068 - RNA, 19 nt, Artificial Sequence
  Description of Artificial Sequence: Synthetic oligonucleotide
cucaguagcacggcggugg

SEQ ID NO: 2069 - RNA, 19 nt, Artificial Sequence
  Description of Artificial Sequence: Synthetic oligonucleotide
gcucaguagcacggcggug

SEQ ID NO: 2070 - RNA, 19 nt, Artificial Sequence
  Description of Artificial Sequence: Synthetic oligonucleotide
cgcucaguagcacggcggu

SEQ ID NO: 2071 - RNA, 19 nt, Artificial Sequence
  Description of Artificial Sequence: Synthetic oligonucleotide
gcgcucaguagcacggcgg

SEQ ID NO: 2072 - RNA, 19 nt, Artificial Sequence
  Description of Artificial Sequence: Synthetic oligonucleotide
agcgcucaguagcacggcg

SEQ ID NO: 2073 - RNA, 19 nt, Artificial Sequence
  Description of Artificial Sequence: Synthetic oligonucleotide
gagcgcucaguagcacggc

SEQ ID NO: 2074 - RNA, 19 nt, Artificial Sequence
  Description of Artificial Sequence: Synthetic oligonucleotide
ugagcgcucaguagcacgg

SEQ ID NO: 2075 - RNA, 19 nt, Artificial Sequence
  Description of Artificial Sequence: Synthetic oligonucleotide
cugagcgcucaguagcacg

SEQ ID NO: 2076 - RNA, 19 nt, Artificial Sequence
  Description of Artificial Sequence: Synthetic oligonucleotide
ccugagcgcucaguagcac

SEQ ID NO: 2077 - RNA, 19 nt, Artificial Sequence
  Description of Artificial Sequence: Synthetic oligonucleotide
cccugagcgcucaguagca

SEQ ID NO: 2078 - RNA, 19 nt, Artificial Sequence
  Description of Artificial Sequence: Synthetic oligonucleotide
gcccugagcgcucaguagc

SEQ ID NO: 2079 - RNA, 19 nt, Artificial Sequence
  Description of Artificial Sequence: Synthetic oligonucleotide
cgcccugagcgcucaguag

SEQ ID NO: 2080 - RNA, 19 nt, Artificial Sequence
  Description of Artificial Sequence: Synthetic oligonucleotide
ccgcccugagcgcucagua

SEQ ID NO: 2081 - RNA, 19 nt, Artificial Sequence
  Description of Artificial Sequence: Synthetic oligonucleotide
uccgcccugagcgcucagu

SEQ ID NO: 2082 - RNA, 19 nt, Artificial Sequence
  Description of Artificial Sequence: Synthetic oligonucleotide
guccgcccugagcgcucag

SEQ ID NO: 2083 - RNA, 19 nt, Artificial Sequence
  Description of Artificial Sequence: Synthetic oligonucleotide
gguccgcccugagcgcuca

SEQ ID NO: 2084 - RNA, 19 nt, Artificial Sequence
  Description of Artificial Sequence: Synthetic oligonucleotide
ggguccgcccugagcgcuc

SEQ ID NO: 2085 - RNA, 19 nt, Artificial Sequence
  Description of Artificial Sequence: Synthetic oligonucleotide
cggguccgcccugagcgcu

SEQ ID NO: 2086 - RNA, 19 nt, Artificial Sequence
  Description of Artificial Sequence: Synthetic oligonucleotide
acggguccgcccugagcgc

SEQ ID NO: 2087 - RNA, 19 nt, Artificial Sequence
  Description of Artificial Sequence: Synthetic oligonucleotide
cacggguccgcccugagcg

SEQ ID NO: 2088 - RNA, 19 nt, Artificial Sequence
  Description of Artificial Sequence: Synthetic oligonucleotide
gcacggguccgcccugagc

SEQ ID NO: 2089 - RNA, 19 nt, Artificial Sequence
  Description of Artificial Sequence: Synthetic oligonucleotide
ugcacggguccgcccugag

SEQ ID NO: 2090 - RNA, 19 nt, Artificial Sequence
  Description of Artificial Sequence: Synthetic oligonucleotide
cugcacggguccgcccuga

SEQ ID NO: 2091 - RNA, 19 nt, Artificial Sequence
  Description of Artificial Sequence: Synthetic oligonucleotide
acugcacggguccgcccug

SEQ ID NO: 2092 - RNA, 19 nt, Artificial Sequence
  Description of Artificial Sequence: Synthetic oligonucleotide
gacugcacggguccgcccu

SEQ ID NO: 2093 - RNA, 19 nt, Artificial Sequence
  Description of Artificial Sequence: Synthetic oligonucleotide
ggacugcacggguccgccc

SEQ ID NO: 2094 - RNA, 19 nt, Artificial Sequence
  Description of Artificial Sequence: Synthetic oligonucleotide
uggacugcacggguccgcc

SEQ ID NO: 2095 - RNA, 19 nt, Artificial Sequence
  Description of Artificial Sequence: Synthetic oligonucleotide
uuggacugcacggguccgc

SEQ ID NO: 2096 - RNA, 19 nt, Artificial Sequence
  Description of Artificial Sequence: Synthetic oligonucleotide
cuuggacugcacggguccg

SEQ ID NO: 2097 - RNA, 19 nt, Artificial Sequence
  Description of Artificial Sequence: Synthetic oligonucleotide
acuuggacugcacgggucc

SEQ ID NO: 2098 - RNA, 19 nt, Artificial Sequence
  Description of Artificial Sequence: Synthetic oligonucleotide
gacuuggacugcacggguc

SEQ ID NO: 2099 - RNA, 19 nt, Artificial Sequence
  Description of Artificial Sequence: Synthetic oligonucleotide
cgacuuggacugcacgggu

SEQ ID NO: 2100 - RNA, 19 nt, Artificial Sequence
  Description of Artificial Sequence: Synthetic oligonucleotide
gcgacuuggacugcacggg

SEQ ID NO: 2101 - RNA, 19 nt, Artificial Sequence
  Description of Artificial Sequence: Synthetic oligonucleotide
ggcgacuuggacugcacgg

SEQ ID NO: 2102 - RNA, 19 nt, Artificial Sequence
  Description of Artificial Sequence: Synthetic oligonucleotide
cggcgacuuggacugcacg

SEQ ID NO: 2103 - RNA, 19 nt, Artificial Sequence
  Description of Artificial Sequence: Synthetic oligonucleotide
gcggcgacuuggacugcac

SEQ ID NO: 2104 - RNA, 19 nt, Artificial Sequence
  Description of Artificial Sequence: Synthetic oligonucleotide
cgcggcgacuuggacugca

SEQ ID NO: 2105 - RNA, 19 nt, Artificial Sequence
  Description of Artificial Sequence: Synthetic oligonucleotide
gcgcggcgacuuggacugc

SEQ ID NO: 2106 - RNA, 19 nt, Artificial Sequence
  Description of Artificial Sequence: Synthetic oligonucleotide
agcgcggcgacuuggacug

SEQ ID NO: 2107 - RNA, 19 nt, Artificial Sequence
  Description of Artificial Sequence: Synthetic oligonucleotide
aagcgcggcgacuuggacu

SEQ ID NO: 2108 - RNA, 19 nt, Artificial Sequence
  Description of Artificial Sequence: Synthetic oligonucleotide
aaagcgcggcgacuuggac

SEQ ID NO: 2109 - RNA, 19 nt, Artificial Sequence
  Description of Artificial Sequence: Synthetic oligonucleotide
caaagcgcggcgacuugga

SEQ ID NO: 2110 - RNA, 19 nt, Artificial Sequence
  Description of Artificial Sequence: Synthetic oligonucleotide
gcaaagcgcggcgacuugg

SEQ ID NO: 2111 - RNA, 19 nt, Artificial Sequence
  Description of Artificial Sequence: Synthetic oligonucleotide
cgcaaagcgcggcgacuug

SEQ ID NO: 2112 - RNA, 19 nt, Artificial Sequence
  Description of Artificial Sequence: Synthetic oligonucleotide
acgcaaagcgcggcgacuu

SEQ ID NO: 2113 - RNA, 19 nt, Artificial Sequence
  Description of Artificial Sequence: Synthetic oligonucleotide
gacgcaaagcgcggcgacu

SEQ ID NO: 2114 - RNA, 19 nt, Artificial Sequence
  Description of Artificial Sequence: Synthetic oligonucleotide
ggacgcaaagcgcggcgac

SEQ ID NO: 2115 - RNA, 19 nt, Artificial Sequence
  Description of Artificial Sequence: Synthetic oligonucleotide
aggacgcaaagcgcggcga

SEQ ID NO: 2116 - RNA, 19 nt, Artificial Sequence
  Description of Artificial Sequence: Synthetic oligonucleotide
caggacgcaaagcgcggcg

SEQ ID NO: 2117 - RNA, 19 nt, Artificial Sequence
  Description of Artificial Sequence: Synthetic oligonucleotide
ccaggacgcaaagcgcggc

SEQ ID NO: 2118 - RNA, 19 nt, Artificial Sequence
  Description of Artificial Sequence: Synthetic oligonucleotide
cccaggacgcaaagcgcgg

SEQ ID NO: 2119 - RNA, 19 nt, Artificial Sequence
  Description of Artificial Sequence: Synthetic oligonucleotide
ucccaggacgcaaagcgcg

SEQ ID NO: 2120 - RNA, 19 nt, Artificial Sequence
  Description of Artificial Sequence: Synthetic oligonucleotide
gucccaggacgcaaagcgc

SEQ ID NO: 2121 - RNA, 19 nt, Artificial Sequence
  Description of Artificial Sequence: Synthetic oligonucleotide
cgucccaggacgcaaagcg

SEQ ID NO: 2122 - RNA, 19 nt, Artificial Sequence
  Description of Artificial Sequence: Synthetic oligonucleotide
ucgucccaggacgcaaagc

SEQ ID NO: 2123 - RNA, 19 nt, Artificial Sequence
  Description of Artificial Sequence: Synthetic oligonucleotide
cucgucccaggacgcaaag

SEQ ID NO: 2124 - RNA, 19 nt, Artificial Sequence
  Description of Artificial Sequence: Synthetic oligonucleotide
ucucgucccaggacgcaaa

SEQ ID NO: 2125 - RNA, 19 nt, Artificial Sequence
  Description of Artificial Sequence: Synthetic oligonucleotide
aucucgucccaggacgcaa

SEQ ID NO: 2126 - RNA, 19 nt, Artificial Sequence
  Description of Artificial Sequence: Synthetic oligonucleotide
caucucgucccaggacgca

SEQ ID NO: 2127 - RNA, 19 nt, Artificial Sequence
  Description of Artificial Sequence: Synthetic oligonucleotide
ucaucucgucccaggacgc

SEQ ID NO: 2128 - RNA, 19 nt, Artificial Sequence
  Description of Artificial Sequence: Synthetic oligonucleotide
uucaucucgucccaggacg

SEQ ID NO: 2129 - RNA, 19 nt, Artificial Sequence
  Description of Artificial Sequence: Synthetic oligonucleotide
auucaucucgucccaggac

SEQ ID NO: 2130 - RNA, 19 nt, Artificial Sequence
  Description of Artificial Sequence: Synthetic oligonucleotide
cauucaucucgucccagga

SEQ ID NO: 2131 - RNA, 19 nt, Artificial Sequence
  Description of Artificial Sequence: Synthetic oligonucleotide
acauucaucucgucccagg

SEQ ID NO: 2132 - RNA, 19 nt, Artificial Sequence
  Description of Artificial Sequence: Synthetic oligonucleotide
gacauucaucucgucccag

SEQ ID NO: 2133 - RNA, 19 nt, Artificial Sequence
  Description of Artificial Sequence: Synthetic oligonucleotide
ggacauucaucucguccca

SEQ ID NO: 2134 - RNA, 19 nt, Artificial Sequence
  Description of Artificial Sequence: Synthetic oligonucleotide
aggacauucaucucguccc

SEQ ID NO: 2135 - RNA, 19 nt, Artificial Sequence
  Description of Artificial Sequence: Synthetic oligonucleotide
caggacauucaucucgucc

SEQ ID NO: 2136 - RNA, 19 nt, Artificial Sequence
  Description of Artificial Sequence: Synthetic oligonucleotide
ccaggacauucaucucguc

SEQ ID NO: 2137 - RNA, 19 nt, Artificial Sequence
  Description of Artificial Sequence: Synthetic oligonucleotide
gccaggacauucaucucgu

SEQ ID NO: 2138 - RNA, 19 nt, Artificial Sequence
  Description of Artificial Sequence: Synthetic oligonucleotide
cgccaggacauucaucucg

SEQ ID NO: 2139 - RNA, 19 nt, Artificial Sequence
  Description of Artificial Sequence: Synthetic oligonucleotide
gcgccaggacauucaucuc

SEQ ID NO: 2140 - RNA, 19 nt, Artificial Sequence
  Description of Artificial Sequence: Synthetic oligonucleotide
ugcgccaggacauucaucu

SEQ ID NO: 2141 - RNA, 19 nt, Artificial Sequence
  Description of Artificial Sequence: Synthetic oligonucleotide
gugcgccaggacauucauc

SEQ ID NO: 2142 - RNA, 19 nt, Artificial Sequence
  Description of Artificial Sequence: Synthetic oligonucleotide
cgugcgccaggacauucau

SEQ ID NO: 2143 - RNA, 19 nt, Artificial Sequence
  Description of Artificial Sequence: Synthetic oligonucleotide
ccgugcgccaggacauuca

SEQ ID NO: 2144 - RNA, 19 nt, Artificial Sequence
  Description of Artificial Sequence: Synthetic oligonucleotide
uccgugcgccaggacauuc

SEQ ID NO: 2145 - RNA, 19 nt, Artificial Sequence
  Description of Artificial Sequence: Synthetic oligonucleotide
guccgugcgccaggacauu

SEQ ID NO: 2146 - RNA, 19 nt, Artificial Sequence
  Description of Artificial Sequence: Synthetic oligonucleotide
aguccgugcgccaggacau

SEQ ID NO: 2147 - RNA, 19 nt, Artificial Sequence
  Description of Artificial Sequence: Synthetic oligonucleotide
gaguccgugcgccaggaca

SEQ ID NO: 2148 - RNA, 19 nt, Artificial Sequence
  Description of Artificial Sequence: Synthetic oligonucleotide
ggaguccgugcgccaggac

SEQ ID NO: 2149 - RNA, 19 nt, Artificial Sequence
  Description of Artificial Sequence: Synthetic oligonucleotide
aggaguccgugcgccagga

SEQ ID NO: 2150 - RNA, 19 nt, Artificial Sequence
  Description of Artificial Sequence: Synthetic oligonucleotide
caggaguccgugcgccagg

SEQ ID NO: 2151 - RNA, 19 nt, Artificial Sequence
  Description of Artificial Sequence: Synthetic oligonucleotide
gcaggaguccgugcgccag

SEQ ID NO: 2152 - RNA, 19 nt, Artificial Sequence
  Description of Artificial Sequence: Synthetic oligonucleotide
ugcaggaguccgugcgcca

SEQ ID NO: 2153 - RNA, 19 nt, Artificial Sequence
  Description of Artificial Sequence: Synthetic oligonucleotide
cugcaggaguccgugcgcc

SEQ ID NO: 2154 - RNA, 19 nt, Artificial Sequence
  Description of Artificial Sequence: Synthetic oligonucleotide
gcugcaggaguccgugcgc

SEQ ID NO: 2155 - RNA, 19 nt, Artificial Sequence
  Description of Artificial Sequence: Synthetic oligonucleotide
agcugcaggaguccgugcg

SEQ ID NO: 2156 - RNA, 19 nt, Artificial Sequence
  Description of Artificial Sequence: Synthetic oligonucleotide
gagcugcaggaguccgugc

SEQ ID NO: 2157 - RNA, 19 nt, Artificial Sequence
  Description of Artificial Sequence: Synthetic oligonucleotide
cgagcugcaggaguccgug

SEQ ID NO: 2158 - RNA, 19 nt, Artificial Sequence
  Description of Artificial Sequence: Synthetic oligonucleotide
ccgagcugcaggaguccgu

SEQ ID NO: 2159 - RNA, 19 nt, Artificial Sequence
  Description of Artificial Sequence: Synthetic oligonucleotide
gccgagcugcaggaguccg

SEQ ID NO: 2160 - RNA, 19 nt, Artificial Sequence
  Description of Artificial Sequence: Synthetic oligonucleotide
ggccgagcugcaggagucc

SEQ ID NO: 2161 - RNA, 19 nt, Artificial Sequence
  Description of Artificial Sequence: Synthetic oligonucleotide
uggccgagcugcaggaguc

SEQ ID NO: 2162 - RNA, 19 nt, Artificial Sequence
  Description of Artificial Sequence: Synthetic oligonucleotide
cuggccgagcugcaggagu

SEQ ID NO: 2163 - RNA, 19 nt, Artificial Sequence
  Description of Artificial Sequence: Synthetic oligonucleotide
ccuggccgagcugcaggag

SEQ ID NO: 2164 - RNA, 19 nt, Artificial Sequence
  Description of Artificial Sequence: Synthetic oligonucleotide
cccuggccgagcugcagga

SEQ ID NO: 2165 - RNA, 19 nt, Artificial Sequence
  Description of Artificial Sequence: Synthetic oligonucleotide
ccccuggccgagcugcagg

SEQ ID NO: 2166 - RNA, 19 nt, Artificial Sequence
  Description of Artificial Sequence: Synthetic oligonucleotide
gccccuggccgagcugcag

SEQ ID NO: 2167 - RNA, 19 nt, Artificial Sequence
  Description of Artificial Sequence: Synthetic oligonucleotide
agccccuggccgagcugca

SEQ ID NO: 2168 - RNA, 19 nt, Artificial Sequence
  Description of Artificial Sequence: Synthetic oligonucleotide
cagccccuggccgagcugc

SEQ ID NO: 2169 - RNA, 19 nt, Artificial Sequence
  Description of Artificial Sequence: Synthetic oligonucleotide
gcagccccuggccgagcug

SEQ ID NO: 2170 - RNA, 19 nt, Artificial Sequence
  Description of Artificial Sequence: Synthetic oligonucleotide
cgcagccccuggccgagcu

SEQ ID NO: 2171 - RNA, 19 nt, Artificial Sequence
  Description of Artificial Sequence: Synthetic oligonucleotide
gcgcagccccuggccgagc

SEQ ID NO: 2172 - RNA, 19 nt, Artificial Sequence
  Description of Artificial Sequence: Synthetic oligonucleotide
cgcgcagccccuggccgag

SEQ ID NO: 2173 - RNA, 19 nt, Artificial Sequence
  Description of Artificial Sequence: Synthetic oligonucleotide
ucgcgcagccccuggccga

SEQ ID NO: 2174 - RNA, 19 nt, Artificial Sequence
  Description of Artificial Sequence: Synthetic oligonucleotide
uucgcgcagccccuggccg

SEQ ID NO: 2175 - RNA, 19 nt, Artificial Sequence
  Description of Artificial Sequence: Synthetic oligonucleotide
guucgcgcagccccuggcc

SEQ ID NO: 2176 - RNA, 19 nt, Artificial Sequence
  Description of Artificial Sequence: Synthetic oligonucleotide
uguucgcgcagccccuggc

SEQ ID NO: 2177 - RNA, 19 nt, Artificial Sequence
  Description of Artificial Sequence: Synthetic oligonucleotide
guguucgcgcagccccugg

SEQ ID NO: 2178 - RNA, 19 nt, Artificial Sequence
  Description of Artificial Sequence: Synthetic oligonucleotide
cguguucgcgcagccccug

SEQ ID NO: 2179 - RNA, 19 nt, Artificial Sequence
  Description of Artificial Sequence: Synthetic oligonucleotide
gcguguucgcgcagccccu

SEQ ID NO: 2180 - RNA, 19 nt, Artificial Sequence
  Description of Artificial Sequence: Synthetic oligonucleotide
cgcguguucgcgcagcccc

SEQ ID NO: 2181 - RNA, 19 nt, Artificial Sequence
  Description of Artificial Sequence: Synthetic oligonucleotide
ccgcguguucgcgcagccc

SEQ ID NO: 2182 - RNA, 19 nt, Artificial Sequence
  Description of Artificial Sequence: Synthetic oligonucleotide
uccgcguguucgcgcagcc

SEQ ID NO: 2183 - RNA, 19 nt, Artificial Sequence
  Description of Artificial Sequence: Synthetic oligonucleotide
cuccgcguguucgcgcagc

SEQ ID NO: 2184 - RNA, 19 nt, Artificial Sequence
  Description of Artificial Sequence: Synthetic oligonucleotide
gcuccgcguguucgcgcag

SEQ ID NO: 2185 - RNA, 19 nt, Artificial Sequence
  Description of Artificial Sequence: Synthetic oligonucleotide
cgcuccgcguguucgcgca

SEQ ID NO: 2186 - RNA, 19 nt, Artificial Sequence
  Description of Artificial Sequence: Synthetic oligonucleotide
gcgcuccgcguguucgcgc

SEQ ID NO: 2187 - RNA, 19 nt, Artificial Sequence
  Description of Artificial Sequence: Synthetic oligonucleotide
ugcgcuccgcguguucgcg

SEQ ID NO: 2188 - RNA, 19 nt, Artificial Sequence
  Description of Artificial Sequence: Synthetic oligonucleotide
gugcgcuccgcguguucgc

SEQ ID NO: 2189 - RNA, 19 nt, Artificial Sequence
  Description of Artificial Sequence: Synthetic oligonucleotide
ggugcgcuccgcguguucg

SEQ ID NO: 2190 - RNA, 19 nt, Artificial Sequence
  Description of Artificial Sequence: Synthetic oligonucleotide
gggugcgcuccgcguguuc

SEQ ID NO: 2191 - RNA, 19 nt, Artificial Sequence
  Description of Artificial Sequence: Synthetic oligonucleotide
cgggugcgcuccgcguguu

SEQ ID NO: 2192 - RNA, 19 nt, Artificial Sequence
  Description of Artificial Sequence: Synthetic oligonucleotide
gcgggugcgcuccgcgugu

SEQ ID NO: 2193 - RNA, 19 nt, Artificial Sequence
  Description of Artificial Sequence: Synthetic oligonucleotide
ugcgggugcgcuccgcgug

SEQ ID NO: 2194 - RNA, 19 nt, Artificial Sequence
  Description of Artificial Sequence: Synthetic oligonucleotide
cugcgggugcgcuccgcgu

SEQ ID NO: 2195 - RNA, 19 nt, Artificial Sequence
  Description of Artificial Sequence: Synthetic oligonucleotide
acugcgggugcgcuccgcg

SEQ ID NO: 2196 - RNA, 19 nt, Artificial Sequence
  Description of Artificial Sequence: Synthetic oligonucleotide
gacugcgggugcgcuccgc

SEQ ID NO: 2197 - RNA, 19 nt, Artificial Sequence
  Description of Artificial Sequence: Synthetic oligonucleotide
ugacugcgggugcgcuccg

SEQ ID NO: 2198 - RNA, 19 nt, Artificial Sequence
  Description of Artificial Sequence: Synthetic oligonucleotide
cugacugcgggugcgcucc

SEQ ID NO: 2199 - RNA, 19 nt, Artificial Sequence
  Description of Artificial Sequence: Synthetic oligonucleotide
gcugacugcgggugcgcuc

SEQ ID NO: 2200 - RNA, 19 nt, Artificial Sequence
  Description of Artificial Sequence: Synthetic oligonucleotide
agcugacugcgggugcgcu

SEQ ID NO: 2201 - RNA, 19 nt, Artificial Sequence
  Description of Artificial Sequence: Synthetic oligonucleotide
cagcugacugcgggugcgc

SEQ ID NO: 2202 - RNA, 19 nt, Artificial Sequence
  Description of Artificial Sequence: Synthetic oligonucleotide
ucagcugacugcgggugcg

SEQ ID NO: 2203 - RNA, 19 nt, Artificial Sequence
  Description of Artificial Sequence: Synthetic oligonucleotide
cucagcugacugcgggugc

SEQ ID NO: 2204 - RNA, 19 nt, Artificial Sequence
  Description of Artificial Sequence: Synthetic oligonucleotide
gcucagcugacugcgggug

SEQ ID NO: 2205 - RNA, 19 nt, Artificial Sequence
  Description of Artificial Sequence: Synthetic oligonucleotide
cgcucagcugacugcgggu

SEQ ID NO: 2206 - RNA, 19 nt, Artificial Sequence
  Description of Artificial Sequence: Synthetic oligonucleotide
gcgcucagcugacugcggg

SEQ ID NO: 2207 - RNA, 19 nt, Artificial Sequence
  Description of Artificial Sequence: Synthetic oligonucleotide
cgcgcucagcugacugcgg

SEQ ID NO: 2208 - RNA, 19 nt, Artificial Sequence
  Description of Artificial Sequence: Synthetic oligonucleotide
gcgcgcucagcugacugcg

SEQ ID NO: 2209 - RNA, 19 nt, Artificial Sequence
  Description of Artificial Sequence: Synthetic oligonucleotide
agcgcgcucagcugacugc

SEQ ID NO: 2210 - RNA, 19 nt, Artificial Sequence
  Description of Artificial Sequence: Synthetic oligonucleotide
cagcgcgcucagcugacug

SEQ ID NO: 2211 - RNA, 19 nt, Artificial Sequence
  Description of Artificial Sequence: Synthetic oligonucleotide
ccagcgcgcucagcugacu

SEQ ID NO: 2212 - RNA, 19 nt, Artificial Sequence
  Description of Artificial Sequence: Synthetic oligonucleotide
uccagcgcgcucagcugac

SEQ ID NO: 2213 - RNA, 19 nt, Artificial Sequence
  Description of Artificial Sequence: Synthetic oligonucleotide
cuccagcgcgcucagcuga

SEQ ID NO: 2214 - RNA, 19 nt, Artificial Sequence
  Description of Artificial Sequence: Synthetic oligonucleotide
gcuccagcgcgcucagcug

SEQ ID NO: 2215 - RNA, 19 nt, Artificial Sequence
  Description of Artificial Sequence: Synthetic oligonucleotide
cgcuccagcgcgcucagcu

SEQ ID NO: 2216 - RNA, 19 nt, Artificial Sequence
  Description of Artificial Sequence: Synthetic oligonucleotide
ccgcuccagcgcgcucagc

SEQ ID NO: 2217 - RNA, 19 nt, Artificial Sequence
  Description of Artificial Sequence: Synthetic oligonucleotide
gccgcuccagcgcgcucag

SEQ ID NO: 2218 - RNA, 19 nt, Artificial Sequence
  Description of Artificial Sequence: Synthetic oligonucleotide
cgccgcuccagcgcgcuca

SEQ ID NO: 2219 - RNA, 19 nt, Artificial Sequence
  Description of Artificial Sequence: Synthetic oligonucleotide
gcgccgcuccagcgcgcuc

SEQ ID NO: 2220 - RNA, 19 nt, Artificial Sequence
  Description of Artificial Sequence: Synthetic oligonucleotide
ggcgccgcuccagcgcgcu

SEQ ID NO: 2221 - RNA, 19 nt, Artificial Sequence
  Description of Artificial Sequence: Synthetic oligonucleotide
aggcgccgcuccagcgcgc

SEQ ID NO: 2222 - RNA, 19 nt, Artificial Sequence
  Description of Artificial Sequence: Synthetic oligonucleotide
caggcgccgcuccagcgcg

SEQ ID NO: 2223 - RNA, 19 nt, Artificial Sequence
  Description of Artificial Sequence: Synthetic oligonucleotide
ucaggcgccgcuccagcgc

SEQ ID NO: 2224 - RNA, 19 nt, Artificial Sequence
  Description of Artificial Sequence: Synthetic oligonucleotide
cucaggcgccgcuccagcg

SEQ ID NO: 2225 - RNA, 19 nt, Artificial Sequence
  Description of Artificial Sequence: Synthetic oligonucleotide
gcucaggcgccgcuccagc

SEQ ID NO: 2226 - RNA, 19 nt, Artificial Sequence
  Description of Artificial Sequence: Synthetic oligonucleotide
cgcucaggcgccgcuccag

SEQ ID NO: 2227 - RNA, 19 nt, Artificial Sequence
  Description of Artificial Sequence: Synthetic oligonucleotide
gcgcucaggcgccgcucca

SEQ ID NO: 2228 - RNA, 19 nt, Artificial Sequence
  Description of Artificial Sequence: Synthetic oligonucleotide
cgcgcucaggcgccgcucc

SEQ ID NO: 2229 - RNA, 19 nt, Artificial Sequence
  Description of Artificial Sequence: Synthetic oligonucleotide
acgcgcucaggcgccgcuc

SEQ ID NO: 2230 - RNA, 19 nt, Artificial Sequence
  Description of Artificial Sequence: Synthetic oligonucleotide
cacgcgcucaggcgccgcu

SEQ ID NO: 2231 - RNA, 19 nt, Artificial Sequence
  Description of Artificial Sequence: Synthetic oligonucleotide
gcacgcgcucaggcgccgc

SEQ ID NO: 2232 - RNA, 19 nt, Artificial Sequence
  Description of Artificial Sequence: Synthetic oligonucleotide
cgcacgcgcucaggcgccg

SEQ ID NO: 2233 - RNA, 19 nt, Artificial Sequence
  Description of Artificial Sequence: Synthetic oligonucleotide
ccgcacgcgcucaggcgcc

SEQ ID NO: 2234 - RNA, 19 nt, Artificial Sequence
  Description of Artificial Sequence: Synthetic oligonucleotide
cccgcacgcgcucaggcgc

SEQ ID NO: 2235 - RNA, 19 nt, Artificial Sequence
  Description of Artificial Sequence: Synthetic oligonucleotide
acccgcacgcgcucaggcg

SEQ ID NO: 2236 - RNA, 19 nt, Artificial Sequence
  Description of Artificial Sequence: Synthetic oligonucleotide
gacccgcacgcgcucaggc

SEQ ID NO: 2237 - RNA, 19 nt, Artificial Sequence
  Description of Artificial Sequence: Synthetic oligonucleotide
ggacccgcacgcgcucagg

SEQ ID NO: 2238 - RNA, 19 nt, Artificial Sequence
  Description of Artificial Sequence: Synthetic oligonucleotide
cggacccgcacgcgcucag

SEQ ID NO: 2239 - RNA, 19 nt, Artificial Sequence
  Description of Artificial Sequence: Synthetic oligonucleotide
gcggacccgcacgcgcuca

SEQ ID NO: 2240 - RNA, 19 nt, Artificial Sequence
  Description of Artificial Sequence: Synthetic oligonucleotide
ggcggacccgcacgcgcuc

SEQ ID NO: 2241 - RNA, 19 nt, Artificial Sequence
  Description of Artificial Sequence: Synthetic oligonucleotide
aggcggacccgcacgcgcu

SEQ ID NO: 2242 - RNA, 19 nt, Artificial Sequence
  Description of Artificial Sequence: Synthetic oligonucleotide
caggcggacccgcacgcgc

SEQ ID NO: 2243 - RNA, 19 nt, Artificial Sequence
  Description of Artificial Sequence: Synthetic oligonucleotide
acaggcggacccgcacgcg

SEQ ID NO: 2244 - RNA, 19 nt, Artificial Sequence
  Description of Artificial Sequence: Synthetic oligonucleotide
gacaggcggacccgcacgc

SEQ ID NO: 2245 - RNA, 19 nt, Artificial Sequence
  Description of Artificial Sequence: Synthetic oligonucleotide
ugacaggcggacccgcacg

SEQ ID NO: 2246 - RNA, 19 nt, Artificial Sequence
  Description of Artificial Sequence: Synthetic oligonucleotide
cugacaggcggacccgcac

SEQ ID NO: 2247 - RNA, 19 nt, Artificial Sequence
  Description of Artificial Sequence: Synthetic oligonucleotide
ccugacaggcggacccgca

SEQ ID NO: 2248 - RNA, 19 nt, Artificial Sequence
  Description of Artificial Sequence: Synthetic oligonucleotide
cccugacaggcggacccgc

SEQ ID NO: 2249 - RNA, 19 nt, Artificial Sequence
  Description of Artificial Sequence: Synthetic oligonucleotide
ucccugacaggcggacccg

SEQ ID NO: 2250 - RNA, 19 nt, Artificial Sequence
  Description of Artificial Sequence: Synthetic oligonucleotide
uucccugacaggcggaccc

SEQ ID NO: 2251 - RNA, 19 nt, Artificial Sequence
  Description of Artificial Sequence: Synthetic oligonucleotide
guucccugacaggcggacc

SEQ ID NO: 2252 - RNA, 19 nt, Artificial Sequence
  Description of Artificial Sequence: Synthetic oligonucleotide
gguucccugacaggcggac

SEQ ID NO: 2253 - RNA, 19 nt, Artificial Sequence
  Description of Artificial Sequence: Synthetic oligonucleotide
cgguucccugacaggcgga

SEQ ID NO: 2254 - RNA, 19 nt, Artificial Sequence
  Description of Artificial Sequence: Synthetic oligonucleotide
ucgguucccugacaggcgg

SEQ ID NO: 2255 - RNA, 19 nt, Artificial Sequence
  Description of Artificial Sequence: Synthetic oligonucleotide
cucgguucccugacaggcg

SEQ ID NO: 2256 - RNA, 19 nt, Artificial Sequence
  Description of Artificial Sequence: Synthetic oligonucleotide
ccucgguucccugacaggc

SEQ ID NO: 2257 - RNA, 19 nt, Artificial Sequence
  Description of Artificial Sequence: Synthetic oligonucleotide
cccucgguucccugacagg

SEQ ID NO: 2258 - RNA, 19 nt, Artificial Sequence
  Description of Artificial Sequence: Synthetic oligonucleotide
ccccucgguucccugacag

SEQ ID NO: 2259 - RNA, 19 nt, Artificial Sequence
  Description of Artificial Sequence: Synthetic oligonucleotide
accccucgguucccugaca

SEQ ID NO: 2260 - RNA, 19 nt, Artificial Sequence
  Description of Artificial Sequence: Synthetic oligonucleotide
gaccccucgguucccugac

SEQ ID NO: 2261 - RNA, 19 nt, Artificial Sequence
  Description of Artificial Sequence: Synthetic oligonucleotide
ggaccccucgguucccuga

SEQ ID NO: 2262 - RNA, 19 nt, Artificial Sequence
  Description of Artificial Sequence: Synthetic oligonucleotide
uggaccccucgguucccug

SEQ ID NO: 2263 - RNA, 19 nt, Artificial Sequence
  Description of Artificial Sequence: Synthetic oligonucleotide
guggaccccucgguucccu

SEQ ID NO: 2264 - RNA, 19 nt, Artificial Sequence
  Description of Artificial Sequence: Synthetic oligonucleotide
gguggaccccucgguuccc

SEQ ID NO: 2265 - RNA, 19 nt, Artificial Sequence
  Description of Artificial Sequence: Synthetic oligonucleotide
cgguggaccccucgguucc

SEQ ID NO: 2266 - RNA, 19 nt, Artificial Sequence
  Description of Artificial Sequence: Synthetic oligonucleotide
ucgguggaccccucgguuc

SEQ ID NO: 2267 - RNA, 19 nt, Artificial Sequence
  Description of Artificial Sequence: Synthetic oligonucleotide
gucgguggaccccucgguu

SEQ ID NO: 2268 - RNA, 19 nt, Artificial Sequence
  Description of Artificial Sequence: Synthetic oligonucleotide
ggucgguggaccccucggu

SEQ ID NO: 2269 - RNA, 19 nt, Artificial Sequence
  Description of Artificial Sequence: Synthetic oligonucleotide
aggucgguggaccccucgg

SEQ ID NO: 2270 - RNA, 19 nt, Artificial Sequence
  Description of Artificial Sequence: Synthetic oligonucleotide
gaggucgguggaccccucg

SEQ ID NO: 2271 - RNA, 19 nt, Artificial Sequence
  Description of Artificial Sequence: Synthetic oligonucleotide
ggaggucgguggaccccuc

SEQ ID NO: 2272 - RNA, 19 nt, Artificial Sequence
  Description of Artificial Sequence: Synthetic oligonucleotide
gggaggucgguggaccccu

SEQ ID NO: 2273 - RNA, 19 nt, Artificial Sequence
  Description of Artificial Sequence: Synthetic oligonucleotide
cgggaggucgguggacccc

SEQ ID NO: 2274 - RNA, 19 nt, Artificial Sequence
  Description of Artificial Sequence: Synthetic oligonucleotide
acgggaggucgguggaccc

SEQ ID NO: 2275 - RNA, 19 nt, Artificial Sequence
  Description of Artificial Sequence: Synthetic oligonucleotide
aacgggaggucgguggacc

SEQ ID NO: 2276 - RNA, 19 nt, Artificial Sequence
  Description of Artificial Sequence: Synthetic oligonucleotide
uaacgggaggucgguggac

SEQ ID NO: 2277 - RNA, 19 nt, Artificial Sequence
  Description of Artificial Sequence: Synthetic oligonucleotide
cuaacgggaggucggugga

SEQ ID NO: 2278 - RNA, 19 nt, Artificial Sequence
  Description of Artificial Sequence: Synthetic oligonucleotide
gcuaacgggaggucggugg

SEQ ID NO: 2279 - RNA, 19 nt, Artificial Sequence
  Description of Artificial Sequence: Synthetic oligonucleotide
ggcuaacgggaggucggug

SEQ ID NO: 2280 - RNA, 19 nt, Artificial Sequence
  Description of Artificial Sequence: Synthetic oligonucleotide
gggcuaacgggaggucggu

SEQ ID NO: 2281 - RNA, 19 nt, Artificial Sequence
  Description of Artificial Sequence: Synthetic oligonucleotide
ggggcuaacgggaggucgg

SEQ ID NO: 2282 - RNA, 19 nt, Artificial Sequence
  Description of Artificial Sequence: Synthetic oligonucleotide
aggggcuaacgggaggucg

SEQ ID NO: 2283 - RNA, 19 nt, Artificial Sequence
  Description of Artificial Sequence: Synthetic oligonucleotide
caggggcuaacgggagguc

SEQ ID NO: 2284 - RNA, 19 nt, Artificial Sequence
  Description of Artificial Sequence: Synthetic oligonucleotide
ucaggggcuaacgggaggu

SEQ ID NO: 2285 - RNA, 19 nt, Artificial Sequence
  Description of Artificial Sequence: Synthetic oligonucleotide
cucaggggcuaacgggagg

SEQ ID NO: 2286 - RNA, 19 nt, Artificial Sequence
  Description of Artificial Sequence: Synthetic oligonucleotide
ucucaggggcuaacgggag

SEQ ID NO: 2287 - RNA, 19 nt, Artificial Sequence
  Description of Artificial Sequence: Synthetic oligonucleotide
cucucaggggcuaacggga

SEQ ID NO: 2288 - RNA, 19 nt, Artificial Sequence
  Description of Artificial Sequence: Synthetic oligonucleotide
gcucucaggggcuaacggg

SEQ ID NO: 2289 - RNA, 19 nt, Artificial Sequence
  Description of Artificial Sequence: Synthetic oligonucleotide
ggcucucaggggcuaacgg

SEQ ID NO: 2290 - RNA, 19 nt, Artificial Sequence
  Description of Artificial Sequence: Synthetic oligonucleotide
cggcucucaggggcuaacg

SEQ ID NO: 2291 - RNA, 19 nt, Artificial Sequence
  Description of Artificial Sequence: Synthetic oligonucleotide
ccggcucucaggggcuaac

SEQ ID NO: 2292 - RNA, 19 nt, Artificial Sequence
  Description of Artificial Sequence: Synthetic oligonucleotide
cccggcucucaggggcuaa

SEQ ID NO: 2293 - RNA, 19 nt, Artificial Sequence
  Description of Artificial Sequence: Synthetic oligonucleotide
acccggcucucaggggcua

SEQ ID NO: 2294 - RNA, 19 nt, Artificial Sequence
  Description of Artificial Sequence: Synthetic oligonucleotide
cacccggcucucaggggcu

SEQ ID NO: 2295 - RNA, 19 nt, Artificial Sequence
  Description of Artificial Sequence: Synthetic oligonucleotide
ccacccggcucucaggggc

SEQ ID NO: 2296 - RNA, 19 nt, Artificial Sequence
  Description of Artificial Sequence: Synthetic oligonucleotide
uccacccggcucucagggg

SEQ ID NO: 2297 - RNA, 19 nt, Artificial Sequence
  Description of Artificial Sequence: Synthetic oligonucleotide
guccacccggcucucaggg

SEQ ID NO: 2298 - RNA, 19 nt, Artificial Sequence
  Description of Artificial Sequence: Synthetic oligonucleotide
gguccacccggcucucagg

SEQ ID NO: 2299 - RNA, 19 nt, Artificial Sequence
  Description of Artificial Sequence: Synthetic oligonucleotide
ggguccacccggcucucag

SEQ ID NO: 2300 - RNA, 19 nt, Artificial Sequence
  Description of Artificial Sequence: Synthetic oligonucleotide
aggguccacccggcucuca

SEQ ID NO: 2301 - RNA, 19 nt, Artificial Sequence
  Description of Artificial Sequence: Synthetic oligonucleotide
caggguccacccggcucuc

SEQ ID NO: 2302 - RNA, 19 nt, Artificial Sequence
  Description of Artificial Sequence: Synthetic oligonucleotide
ucaggguccacccggcucu

SEQ ID NO: 2303 - RNA, 19 nt, Artificial Sequence
  Description of Artificial Sequence: Synthetic oligonucleotide
cucaggguccacccggcuc

SEQ ID NO: 2304 - RNA, 19 nt, Artificial Sequence
  Description of Artificial Sequence: Synthetic oligonucleotide
ccucaggguccacccggcu

SEQ ID NO: 2305 - RNA, 19 nt, Artificial Sequence
  Description of Artificial Sequence: Synthetic oligonucleotide
accucaggguccacccggc

SEQ ID NO: 2306 - RNA, 19 nt, Artificial Sequence
  Description of Artificial Sequence: Synthetic oligonucleotide
gaccucaggguccacccgg

SEQ ID NO: 2307 - RNA, 19 nt, Artificial Sequence
  Description of Artificial Sequence: Synthetic oligonucleotide
ggaccucaggguccacccg

SEQ ID NO: 2308 - RNA, 19 nt, Artificial Sequence
  Description of Artificial Sequence: Synthetic oligonucleotide
aggaccucaggguccaccc

SEQ ID NO: 2309 - RNA, 19 nt, Artificial Sequence
  Description of Artificial Sequence: Synthetic oligonucleotide
aaggaccucaggguccacc

SEQ ID NO: 2310 - RNA, 19 nt, Artificial Sequence
  Description of Artificial Sequence: Synthetic oligonucleotide
gaaggaccucaggguccac

SEQ ID NO: 2311 - RNA, 19 nt, Artificial Sequence
  Description of Artificial Sequence: Synthetic oligonucleotide
ugaaggaccucagggucca

SEQ ID NO: 2312 - RNA, 19 nt, Artificial Sequence
  Description of Artificial Sequence: Synthetic oligonucleotide
gugaaggaccucagggucc

SEQ ID NO: 2313 - RNA, 19 nt, Artificial Sequence
  Description of Artificial Sequence: Synthetic oligonucleotide
ugugaaggaccucaggguc

SEQ ID NO: 2314 - RNA, 19 nt, Artificial Sequence
  Description of Artificial Sequence: Synthetic oligonucleotide
cugugaaggaccucagggu

SEQ ID NO: 2315 - RNA, 19 nt, Artificial Sequence
  Description of Artificial Sequence: Synthetic oligonucleotide
gcugugaaggaccucaggg

SEQ ID NO: 2316 - RNA, 19 nt, Artificial Sequence
  Description of Artificial Sequence: Synthetic oligonucleotide
ggcugugaaggaccucagg

SEQ ID NO: 2317 - RNA, 19 nt, Artificial Sequence
  Description of Artificial Sequence: Synthetic oligonucleotide
aggcugugaaggaccucag

SEQ ID NO: 2318 - RNA, 19 nt, Artificial Sequence
  Description of Artificial Sequence: Synthetic oligonucleotide
caggcugugaaggaccuca

SEQ ID NO: 2319 - RNA, 19 nt, Artificial Sequence
  Description of Artificial Sequence: Synthetic oligonucleotide
gcaggcugugaaggaccuc

SEQ ID NO: 2320 - RNA, 19 nt, Artificial Sequence
  Description of Artificial Sequence: Synthetic oligonucleotide
ugcaggcugugaaggaccu

SEQ ID NO: 2321 - RNA, 19 nt, Artificial Sequence
  Description of Artificial Sequence: Synthetic oligonucleotide
cugcaggcugugaaggacc

SEQ ID NO: 2322 - RNA, 19 nt, Artificial Sequence
  Description of Artificial Sequence: Synthetic oligonucleotide
ucugcaggcugugaaggac

SEQ ID NO: 2323 - RNA, 19 nt, Artificial Sequence
  Description of Artificial Sequence: Synthetic oligonucleotide
gucugcaggcugugaagga

SEQ ID NO: 2324 - RNA, 19 nt, Artificial Sequence
  Description of Artificial Sequence: Synthetic oligonucleotide
ugucugcaggcugugaagg

SEQ ID NO: 2325 - RNA, 19 nt, Artificial Sequence
  Description of Artificial Sequence: Synthetic oligonucleotide
gugucugcaggcugugaag

SEQ ID NO: 2326 - RNA, 19 nt, Artificial Sequence
  Description of Artificial Sequence: Synthetic oligonucleotide
ugugucugcaggcugugaa

SEQ ID NO: 2327 - RNA, 19 nt, Artificial Sequence
  Description of Artificial Sequence: Synthetic oligonucleotide
uugugucugcaggcuguga

SEQ ID NO: 2328 - RNA, 19 nt, Artificial Sequence
  Description of Artificial Sequence: Synthetic oligonucleotide
guugugucugcaggcugug

SEQ ID NO: 2329 - RNA, 19 nt, Artificial Sequence
  Description of Artificial Sequence: Synthetic oligonucleotide
aguugugucugcaggcugu

SEQ ID NO: 2330 - RNA, 19 nt, Artificial Sequence
  Description of Artificial Sequence: Synthetic oligonucleotide
gaguugugucugcaggcug

SEQ ID NO: 2331 - RNA, 19 nt, Artificial Sequence
  Description of Artificial Sequence: Synthetic oligonucleotide
ugaguugugucugcaggcu

SEQ ID NO: 2332 - RNA, 19 nt, Artificial Sequence
  Description of Artificial Sequence: Synthetic oligonucleotide
uugaguugugucugcaggc

SEQ ID NO: 2333 - RNA, 19 nt, Artificial Sequence
  Description of Artificial Sequence: Synthetic oligonucleotide
cuugaguugugucugcagg

SEQ ID NO: 2334 - RNA, 19 nt, Artificial Sequence
  Description of Artificial Sequence: Synthetic oligonucleotide
ccuugaguugugucugcag

SEQ ID NO: 2335 - RNA, 19 nt, Artificial Sequence
  Description of Artificial Sequence: Synthetic oligonucleotide
gccuugaguugugucugca

SEQ ID NO: 2336 - RNA, 19 nt, Artificial Sequence
  Description of Artificial Sequence: Synthetic oligonucleotide
agccuugaguugugucugc

SEQ ID NO: 2337 - RNA, 19 nt, Artificial Sequence
  Description of Artificial Sequence: Synthetic oligonucleotide
gagccuugaguugugucug

SEQ ID NO: 2338 - RNA, 19 nt, Artificial Sequence
  Description of Artificial Sequence: Synthetic oligonucleotide
ugagccuugaguugugucu

SEQ ID NO: 2339 - RNA, 19 nt, Artificial Sequence
  Description of Artificial Sequence: Synthetic oligonucleotide
cugagccuugaguuguguc

SEQ ID NO: 2340 - RNA, 19 nt, Artificial Sequence
  Description of Artificial Sequence: Synthetic oligonucleotide
ucugagccuugaguugugu

SEQ ID NO: 2341 - RNA, 19 nt, Artificial Sequence
  Description of Artificial Sequence: Synthetic oligonucleotide
uucugagccuugaguugug

SEQ ID NO: 2342 - RNA, 19 nt, Artificial Sequence
  Description of Artificial Sequence: Synthetic oligonucleotide
guucugagccuugaguugu

SEQ ID NO: 2343 - RNA, 19 nt, Artificial Sequence
  Description of Artificial Sequence: Synthetic oligonucleotide
uguucugagccuugaguug

SEQ ID NO: 2344 - RNA, 19 nt, Artificial Sequence
  Description of Artificial Sequence: Synthetic oligonucleotide
cuguucugagccuugaguu

SEQ ID NO: 2345 - RNA, 19 nt, Artificial Sequence
  Description of Artificial Sequence: Synthetic oligonucleotide
gcuguucugagccuugagu

SEQ ID NO: 2346 - RNA, 19 nt, Artificial Sequence
  Description of Artificial Sequence: Synthetic oligonucleotide
ugcuguucugagccuugag

SEQ ID NO: 2347 - RNA, 19 nt, Artificial Sequence
  Description of Artificial Sequence: Synthetic oligonucleotide
cugcuguucugagccuuga

SEQ ID NO: 2348 - RNA, 19 nt, Artificial Sequence
  Description of Artificial Sequence: Synthetic oligonucleotide
ccugcuguucugagccuug

SEQ ID NO: 2349 - RNA, 19 nt, Artificial Sequence
  Description of Artificial Sequence: Synthetic oligonucleotide
uccugcuguucugagccuu

SEQ ID NO: 2350 - RNA, 19 nt, Artificial Sequence
  Description of Artificial Sequence: Synthetic oligonucleotide
auccugcuguucugagccu

SEQ ID NO: 2351 - RNA, 19 nt, Artificial Sequence
  Description of Artificial Sequence: Synthetic oligonucleotide
gauccugcuguucugagcc

SEQ ID NO: 2352 - RNA, 19 nt, Artificial Sequence
  Description of Artificial Sequence: Synthetic oligonucleotide
ggauccugcuguucugagc

SEQ ID NO: 2353 - RNA, 19 nt, Artificial Sequence
  Description of Artificial Sequence: Synthetic oligonucleotide
uggauccugcuguucugag

SEQ ID NO: 2354 - RNA, 19 nt, Artificial Sequence
  Description of Artificial Sequence: Synthetic oligonucleotide
cuggauccugcuguucuga

SEQ ID NO: 2355 - RNA, 19 nt, Artificial Sequence
  Description of Artificial Sequence: Synthetic oligonucleotide
gcuggauccugcuguucug

SEQ ID NO: 2356 - RNA, 19 nt, Artificial Sequence
  Description of Artificial Sequence: Synthetic oligonucleotide
ugcuggauccugcuguucu

SEQ ID NO: 2357 - RNA, 19 nt, Artificial Sequence
  Description of Artificial Sequence: Synthetic oligonucleotide
uugcuggauccugcuguuc

SEQ ID NO: 2358 - RNA, 19 nt, Artificial Sequence
  Description of Artificial Sequence: Synthetic oligonucleotide
guugcuggauccugcuguu

SEQ ID NO: 2359 - RNA, 19 nt, Artificial Sequence
  Description of Artificial Sequence: Synthetic oligonucleotide
aguugcuggauccugcugu

SEQ ID NO: 2360 - RNA, 19 nt, Artificial Sequence
  Description of Artificial Sequence: Synthetic oligonucleotide
gaguugcuggauccugcug

SEQ ID NO: 2361 - RNA, 19 nt, Artificial Sequence
  Description of Artificial Sequence: Synthetic oligonucleotide
agaguugcuggauccugcu

SEQ ID NO: 2362 - RNA, 19 nt, Artificial Sequence
  Description of Artificial Sequence: Synthetic oligonucleotide
aagaguugcuggauccugc

SEQ ID NO: 2363 - RNA, 19 nt, Artificial Sequence
  Description of Artificial Sequence: Synthetic oligonucleotide
gaagaguugcuggauccug

SEQ ID NO: 2364 - RNA, 19 nt, Artificial Sequence
  Description of Artificial Sequence: Synthetic oligonucleotide
ggaagaguugcuggauccu

SEQ ID NO: 2365 - RNA, 19 nt, Artificial Sequence
  Description of Artificial Sequence: Synthetic oligonucleotide
uggaagaguugcuggaucc

SEQ ID NO: 2366 - RNA, 19 nt, Artificial Sequence
  Description of Artificial Sequence: Synthetic oligonucleotide
guggaagaguugcuggauc

SEQ ID NO: 2367 - RNA, 19 nt, Artificial Sequence
  Description of Artificial Sequence: Synthetic oligonucleotide
uguggaagaguugcuggau

SEQ ID NO: 2368 - RNA, 19 nt, Artificial Sequence
  Description of Artificial Sequence: Synthetic oligonucleotide
uuguggaagaguugcugga

SEQ ID NO: 2369 - RNA, 19 nt, Artificial Sequence
  Description of Artificial Sequence: Synthetic oligonucleotide
cuuguggaagaguugcugg

SEQ ID NO: 2370 - RNA, 19 nt, Artificial Sequence
  Description of Artificial Sequence: Synthetic oligonucleotide
ccuuguggaagaguugcug

SEQ ID NO: 2371 - RNA, 19 nt, Artificial Sequence
  Description of Artificial Sequence: Synthetic oligonucleotide
accuuguggaagaguugcu

SEQ ID NO: 2372 - RNA, 19 nt, Artificial Sequence
  Description of Artificial Sequence: Synthetic oligonucleotide
caccuuguggaagaguugc

SEQ ID NO: 2373 - RNA, 19 nt, Artificial Sequence
  Description of Artificial Sequence: Synthetic oligonucleotide
ccaccuuguggaagaguug

SEQ ID NO: 2374 - RNA, 19 nt, Artificial Sequence
  Description of Artificial Sequence: Synthetic oligonucleotide
gccaccuuguggaagaguu

SEQ ID NO: 2375 - RNA, 19 nt, Artificial Sequence
  Description of Artificial Sequence: Synthetic oligonucleotide
ggccaccuuguggaagagu

SEQ ID NO: 2376 - RNA, 19 nt, Artificial Sequence
  Description of Artificial Sequence: Synthetic oligonucleotide
gggccaccuuguggaagag

SEQ ID NO: 2377 - RNA, 19 nt, Artificial Sequence
  Description of Artificial Sequence: Synthetic oligonucleotide
ugggccaccuuguggaaga

SEQ ID NO: 2378 - RNA, 19 nt, Artificial Sequence
  Description of Artificial Sequence: Synthetic oligonucleotide
cugggccaccuuguggaag

SEQ ID NO: 2379 - RNA, 19 nt, Artificial Sequence
  Description of Artificial Sequence: Synthetic oligonucleotide
gcugggccaccuuguggaa

SEQ ID NO: 2380 - RNA, 19 nt, Artificial Sequence
  Description of Artificial Sequence: Synthetic oligonucleotide
ugcugggccaccuugugga

SEQ ID NO: 2381 - RNA, 19 nt, Artificial Sequence
  Description of Artificial Sequence: Synthetic oligonucleotide
cugcugggccaccuugugg

SEQ ID NO: 2382 - RNA, 19 nt, Artificial Sequence
  Description of Artificial Sequence: Synthetic oligonucleotide
gcugcugggccaccuugug

SEQ ID NO: 2383 - RNA, 19 nt, Artificial Sequence
  Description of Artificial Sequence: Synthetic oligonucleotide
ugcugcugggccaccuugu

SEQ ID NO: 2384 - RNA, 19 nt, Artificial Sequence
  Description of Artificial Sequence: Synthetic oligonucleotide
cugcugcugggccaccuug

SEQ ID NO: 2385 - RNA, 19 nt, Artificial Sequence
  Description of Artificial Sequence: Synthetic oligonucleotide
gcugcugcugggccaccuu

SEQ ID NO: 2386 - RNA, 19 nt, Artificial Sequence
  Description of Artificial Sequence: Synthetic oligonucleotide
cgcugcugcugggccaccu

SEQ ID NO: 2387 - RNA, 19 nt, Artificial Sequence
  Description of Artificial Sequence: Synthetic oligonucleotide
ccgcugcugcugggccacc

SEQ ID NO: 2388 - RNA, 19 nt, Artificial Sequence
  Description of Artificial Sequence: Synthetic oligonucleotide
gccgcugcugcugggccac

SEQ ID NO: 2389 - RNA, 19 nt, Artificial Sequence
  Description of Artificial Sequence: Synthetic oligonucleotide
ugccgcugcugcugggcca

SEQ ID NO: 2390 - RNA, 19 nt, Artificial Sequence
  Description of Artificial Sequence: Synthetic oligonucleotide
gugccgcugcugcugggcc

SEQ ID NO: 2391 - RNA, 19 nt, Artificial Sequence
  Description of Artificial Sequence: Synthetic oligonucleotide
ggugccgcugcugcugggc

SEQ ID NO: 2392 - RNA, 19 nt, Artificial Sequence
  Description of Artificial Sequence: Synthetic oligonucleotide
aggugccgcugcugcuggg

SEQ ID NO: 2393 - RNA, 19 nt, Artificial Sequence
  Description of Artificial Sequence: Synthetic oligonucleotide
caggugccgcugcugcugg

SEQ ID NO: 2394 - RNA, 19 nt, Artificial Sequence
  Description of Artificial Sequence: Synthetic oligonucleotide
ccaggugccgcugcugcug

SEQ ID NO: 2395 - RNA, 19 nt, Artificial Sequence
  Description of Artificial Sequence: Synthetic oligonucleotide
uccaggugccgcugcugcu

SEQ ID NO: 2396 - RNA, 19 nt, Artificial Sequence
  Description of Artificial Sequence: Synthetic oligonucleotide
cuccaggugccgcugcugc

SEQ ID NO: 2397 - RNA, 19 nt, Artificial Sequence
  Description of Artificial Sequence: Synthetic oligonucleotide
ucuccaggugccgcugcug

SEQ ID NO: 2398 - RNA, 19 nt, Artificial Sequence
  Description of Artificial Sequence: Synthetic oligonucleotide
uucuccaggugccgcugcu

SEQ ID NO: 2399 - RNA, 19 nt, Artificial Sequence
  Description of Artificial Sequence: Synthetic oligonucleotide
cuucuccaggugccgcugc

SEQ ID NO: 2400 - RNA, 19 nt, Artificial Sequence
  Description of Artificial Sequence: Synthetic oligonucleotide
gcuucuccaggugccgcug

SEQ ID NO: 2401 - RNA, 19 nt, Artificial Sequence
  Description of Artificial Sequence: Synthetic oligonucleotide
ugcuucuccaggugccgcu

SEQ ID NO: 2402 - RNA, 19 nt, Artificial Sequence
  Description of Artificial Sequence: Synthetic oligonucleotide
cugcuucuccaggugccgc

SEQ ID NO: 2403 - RNA, 19 nt, Artificial Sequence
  Description of Artificial Sequence: Synthetic oligonucleotide
gcugcuucuccaggugccg

SEQ ID NO: 2404 - RNA, 19 nt, Artificial Sequence
  Description of Artificial Sequence: Synthetic oligonucleotide
ugcugcuucuccaggugcc

SEQ ID NO: 2405 - RNA, 19 nt, Artificial Sequence
  Description of Artificial Sequence: Synthetic oligonucleotide
gugcugcuucuccaggugc

SEQ ID NO: 2406 - RNA, 19 nt, Artificial Sequence
  Description of Artificial Sequence: Synthetic oligonucleotide
ggugcugcuucuccaggug

SEQ ID NO: 2407 - RNA, 19 nt, Artificial Sequence
  Description of Artificial Sequence: Synthetic oligonucleotide
aggugcugcuucuccaggu

SEQ ID NO: 2408 - RNA, 19 nt, Artificial Sequence
  Description of Artificial Sequence: Synthetic oligonucleotide
caggugcugcuucuccagg

SEQ ID NO: 2409 - RNA, 19 nt, Artificial Sequence
  Description of Artificial Sequence: Synthetic oligonucleotide
gcaggugcugcuucuccag

SEQ ID NO: 2410 - RNA, 19 nt, Artificial Sequence
  Description of Artificial Sequence: Synthetic oligonucleotide
cgcaggugcugcuucucca

SEQ ID NO: 2411 - RNA, 19 nt, Artificial Sequence
  Description of Artificial Sequence: Synthetic oligonucleotide
ucgcaggugcugcuucucc

SEQ ID NO: 2412 - RNA, 19 nt, Artificial Sequence
  Description of Artificial Sequence: Synthetic oligonucleotide
uucgcaggugcugcuucuc

SEQ ID NO: 2413 - RNA, 19 nt, Artificial Sequence
  Description of Artificial Sequence: Synthetic oligonucleotide
auucgcaggugcugcuucu

SEQ ID NO: 2414 - RNA, 19 nt, Artificial Sequence
  Description of Artificial Sequence: Synthetic oligonucleotide
aauucgcaggugcugcuuc

SEQ ID NO: 2415 - RNA, 19 nt, Artificial Sequence
  Description of Artificial Sequence: Synthetic oligonucleotide
gaauucgcaggugcugcuu

SEQ ID NO: 2416 - RNA, 19 nt, Artificial Sequence
  Description of Artificial Sequence: Synthetic oligonucleotide
ugaauucgcaggugcugcu

SEQ ID NO: 2417 - RNA, 19 nt, Artificial Sequence
  Description of Artificial Sequence: Synthetic oligonucleotide
cugaauucgcaggugcugc

SEQ ID NO: 2418 - RNA, 19 nt, Artificial Sequence
  Description of Artificial Sequence: Synthetic oligonucleotide
gcugaauucgcaggugcug

SEQ ID NO: 2419 - RNA, 19 nt, Artificial Sequence
  Description of Artificial Sequence: Synthetic oligonucleotide
ugcugaauucgcaggugcu

SEQ ID NO: 2420 - RNA, 19 nt, Artificial Sequence
  Description of Artificial Sequence: Synthetic oligonucleotide
augcugaauucgcaggugc

SEQ ID NO: 2421 - RNA, 19 nt, Artificial Sequence
  Description of Artificial Sequence: Synthetic oligonucleotide
gaugcugaauucgcaggug

SEQ ID NO: 2422 - RNA, 19 nt, Artificial Sequence
  Description of Artificial Sequence: Synthetic oligonucleotide
agaugcugaauucgcaggu

SEQ ID NO: 2423 - RNA, 19 nt, Artificial Sequence
  Description of Artificial Sequence: Synthetic oligonucleotide
cagaugcugaauucgcagg

SEQ ID NO: 2424 - RNA, 19 nt, Artificial Sequence
  Description of Artificial Sequence: Synthetic oligonucleotide
gcagaugcugaauucgcag

SEQ ID NO: 2425 - RNA, 19 nt, Artificial Sequence
  Description of Artificial Sequence: Synthetic oligonucleotide
ugcagaugcugaauucgca

SEQ ID NO: 2426 - RNA, 19 nt, Artificial Sequence
  Description of Artificial Sequence: Synthetic oligonucleotide
uugcagaugcugaauucgc

SEQ ID NO: 2427 - RNA, 19 nt, Artificial Sequence
  Description of Artificial Sequence: Synthetic oligonucleotide
uuugcagaugcugaauucg

SEQ ID NO: 2428 - RNA, 19 nt, Artificial Sequence
  Description of Artificial Sequence: Synthetic oligonucleotide
cuuugcagaugcugaauuc

SEQ ID NO: 2429 - RNA, 19 nt, Artificial Sequence
  Description of Artificial Sequence: Synthetic oligonucleotide
gcuuugcagaugcugaauu

SEQ ID NO: 2430 - RNA, 19 nt, Artificial Sequence
  Description of Artificial Sequence: Synthetic oligonucleotide
ggcuuugcagaugcugaau

SEQ ID NO: 2431 - RNA, 19 nt, Artificial Sequence
  Description of Artificial Sequence: Synthetic oligonucleotide
uggcuuugcagaugcugaa

SEQ ID NO: 2432 - RNA, 19 nt, Artificial Sequence
  Description of Artificial Sequence: Synthetic oligonucleotide
cuggcuuugcagaugcuga

SEQ ID NO: 2433 - RNA, 19 nt, Artificial Sequence
  Description of Artificial Sequence: Synthetic oligonucleotide
acuggcuuugcagaugcug

SEQ ID NO: 2434 - RNA, 19 nt, Artificial Sequence
  Description of Artificial Sequence: Synthetic oligonucleotide
aacuggcuuugcagaugcu

SEQ ID NO: 2435 - RNA, 19 nt, Artificial Sequence
  Description of Artificial Sequence: Synthetic oligonucleotide
aaacuggcuuugcagaugc

SEQ ID NO: 2436 - RNA, 19 nt, Artificial Sequence
  Description of Artificial Sequence: Synthetic oligonucleotide
caaacuggcuuugcagaug

SEQ ID NO: 2437 - RNA, 19 nt, Artificial Sequence
  Description of Artificial Sequence: Synthetic oligonucleotide
ccaaacuggcuuugcagau

SEQ ID NO: 2438 - RNA, 19 nt, Artificial Sequence
  Description of Artificial Sequence: Synthetic oligonucleotide
gccaaacuggcuuugcaga

SEQ ID NO: 2439 - RNA, 19 nt, Artificial Sequence
  Description of Artificial Sequence: Synthetic oligonucleotide
ggccaaacuggcuuugcag

SEQ ID NO: 2440 - RNA, 19 nt, Artificial Sequence
  Description of Artificial Sequence: Synthetic oligonucleotide
aggccaaacuggcuuugca

SEQ ID NO: 2441 - RNA, 19 nt, Artificial Sequence
  Description of Artificial Sequence: Synthetic oligonucleotide
gaggccaaacuggcuuugc

SEQ ID NO: 2442 - RNA, 19 nt, Artificial Sequence
  Description of Artificial Sequence: Synthetic oligonucleotide
ggaggccaaacuggcuuug

SEQ ID NO: 2443 - RNA, 19 nt, Artificial Sequence
  Description of Artificial Sequence: Synthetic oligonucleotide
aggaggccaaacuggcuuu

SEQ ID NO: 2444 - RNA, 19 nt, Artificial Sequence
  Description of Artificial Sequence: Synthetic oligonucleotide
caggaggccaaacuggcuu

SEQ ID NO: 2445 - RNA, 19 nt, Artificial Sequence
  Description of Artificial Sequence: Synthetic oligonucleotide
ccaggaggccaaacuggcu

SEQ ID NO: 2446 - RNA, 19 nt, Artificial Sequence
  Description of Artificial Sequence: Synthetic oligonucleotide
uccaggaggccaaacuggc

SEQ ID NO: 2447 - RNA, 19 nt, Artificial Sequence
  Description of Artificial Sequence: Synthetic oligonucleotide
guccaggaggccaaacugg

SEQ ID NO: 2448 - RNA, 19 nt, Artificial Sequence
  Description of Artificial Sequence: Synthetic oligonucleotide
gguccaggaggccaaacug

SEQ ID NO: 2449 - RNA, 19 nt, Artificial Sequence
  Description of Artificial Sequence: Synthetic oligonucleotide
ugguccaggaggccaaacu

SEQ ID NO: 2450 - RNA, 19 nt, Artificial Sequence
  Description of Artificial Sequence: Synthetic oligonucleotide
gugguccaggaggccaaac

SEQ ID NO: 2451 - RNA, 19 nt, Artificial Sequence
  Description of Artificial Sequence: Synthetic oligonucleotide
ugugguccaggaggccaaa

SEQ ID NO: 2452 - RNA, 19 nt, Artificial Sequence
  Description of Artificial Sequence: Synthetic oligonucleotide
uugugguccaggaggccaa

SEQ ID NO: 2453 - RNA, 19 nt, Artificial Sequence
  Description of Artificial Sequence: Synthetic oligonucleotide
cuugugguccaggaggcca

SEQ ID NO: 2454 - RNA, 19 nt, Artificial Sequence
  Description of Artificial Sequence: Synthetic oligonucleotide
gcuugugguccaggaggcc

SEQ ID NO: 2455 - RNA, 19 nt, Artificial Sequence
  Description of Artificial Sequence: Synthetic oligonucleotide
ugcuugugguccaggaggc

SEQ ID NO: 2456 - RNA, 19 nt, Artificial Sequence
  Description of Artificial Sequence: Synthetic oligonucleotide
gugcuugugguccaggagg

SEQ ID NO: 2457 - RNA, 19 nt, Artificial Sequence
  Description of Artificial Sequence: Synthetic oligonucleotide
ggugcuugugguccaggag

SEQ ID NO: 2458 - RNA, 19 nt, Artificial Sequence
  Description of Artificial Sequence: Synthetic oligonucleotide
aggugcuugugguccagga

SEQ ID NO: 2459 - RNA, 19 nt, Artificial Sequence
  Description of Artificial Sequence: Synthetic oligonucleotide
uaggugcuugugguccagg

SEQ ID NO: 2460 - RNA, 19 nt, Artificial Sequence
  Description of Artificial Sequence: Synthetic oligonucleotide
cuaggugcuugugguccag

SEQ ID NO: 2461 - RNA, 19 nt, Artificial Sequence
  Description of Artificial Sequence: Synthetic oligonucleotide
ucuaggugcuuguggucca

SEQ ID NO: 2462 - RNA, 19 nt, Artificial Sequence
  Description of Artificial Sequence: Synthetic oligonucleotide
gucuaggugcuuguggucc

SEQ ID NO: 2463 - RNA, 19 nt, Artificial Sequence
  Description of Artificial Sequence: Synthetic oligonucleotide
ggucuaggugcuugugguc

SEQ ID NO: 2464 - RNA, 19 nt, Artificial Sequence
  Description of Artificial Sequence: Synthetic oligonucleotide
uggucuaggugcuuguggu

SEQ ID NO: 2465 - RNA, 19 nt, Artificial Sequence
  Description of Artificial Sequence: Synthetic oligonucleotide
auggucuaggugcuugugg

SEQ ID NO: 2466 - RNA, 19 nt, Artificial Sequence
  Description of Artificial Sequence: Synthetic oligonucleotide
cauggucuaggugcuugug

SEQ ID NO: 2467 - RNA, 19 nt, Artificial Sequence
  Description of Artificial Sequence: Synthetic oligonucleotide
ucauggucuaggugcuugu

SEQ ID NO: 2468 - RNA, 19 nt, Artificial Sequence
  Description of Artificial Sequence: Synthetic oligonucleotide
cucauggucuaggugcuug

SEQ ID NO: 2469 - RNA, 19 nt, Artificial Sequence
  Description of Artificial Sequence: Synthetic oligonucleotide
ccucauggucuaggugcuu

SEQ ID NO: 2470 - RNA, 19 nt, Artificial Sequence
  Description of Artificial Sequence: Synthetic oligonucleotide
accucauggucuaggugcu

SEQ ID NO: 2471 - RNA, 19 nt, Artificial Sequence
  Description of Artificial Sequence: Synthetic oligonucleotide
caccucauggucuaggugc

SEQ ID NO: 2472 - RNA, 19 nt, Artificial Sequence
  Description of Artificial Sequence: Synthetic oligonucleotide
ccaccucauggucuaggug

SEQ ID NO: 2473 - RNA, 19 nt, Artificial Sequence
  Description of Artificial Sequence: Synthetic oligonucleotide
gccaccucauggucuaggu

SEQ ID NO: 2474 - RNA, 19 nt, Artificial Sequence
  Description of Artificial Sequence: Synthetic oligonucleotide
ggccaccucauggucuagg

SEQ ID NO: 2475 - RNA, 19 nt, Artificial Sequence
  Description of Artificial Sequence: Synthetic oligonucleotide
uggccaccucauggucuag

SEQ ID NO: 2476 - RNA, 19 nt, Artificial Sequence
  Description of Artificial Sequence: Synthetic oligonucleotide
uuggccaccucauggucua

SEQ ID NO: 2477 - RNA, 19 nt, Artificial Sequence
  Description of Artificial Sequence: Synthetic oligonucleotide
cuuggccaccucauggucu

SEQ ID NO: 2478 - RNA, 19 nt, Artificial Sequence
  Description of Artificial Sequence: Synthetic oligonucleotide
gcuuggccaccucaugguc

SEQ ID NO: 2479 - RNA, 19 nt, Artificial Sequence
  Description of Artificial Sequence: Synthetic oligonucleotide
ggcuuggccaccucauggu

SEQ ID NO: 2480 - RNA, 19 nt, Artificial Sequence
  Description of Artificial Sequence: Synthetic oligonucleotide
aggcuuggccaccucaugg

SEQ ID NO: 2481 - RNA, 19 nt, Artificial Sequence
  Description of Artificial Sequence: Synthetic oligonucleotide
caggcuuggccaccucaug

SEQ ID NO: 2482 - RNA, 19 nt, Artificial Sequence
  Description of Artificial Sequence: Synthetic oligonucleotide
gcaggcuuggccaccucau

SEQ ID NO: 2483 - RNA, 19 nt, Artificial Sequence
  Description of Artificial Sequence: Synthetic oligonucleotide
ggcaggcuuggccaccuca

SEQ ID NO: 2484 - RNA, 19 nt, Artificial Sequence
  Description of Artificial Sequence: Synthetic oligonucleotide
gggcaggcuuggccaccuc

SEQ ID NO: 2485 - RNA, 19 nt, Artificial Sequence
  Description of Artificial Sequence: Synthetic oligonucleotide
cgggcaggcuuggccaccu

SEQ ID NO: 2486 - RNA, 19 nt, Artificial Sequence
  Description of Artificial Sequence: Synthetic oligonucleotide
ucgggcaggcuuggccacc

SEQ ID NO: 2487 - RNA, 19 nt, Artificial Sequence
  Description of Artificial Sequence: Synthetic oligonucleotide
uucgggcaggcuuggccac

SEQ ID NO: 2488 - RNA, 19 nt, Artificial Sequence
  Description of Artificial Sequence: Synthetic oligonucleotide
cuucgggcaggcuuggcca

SEQ ID NO: 2489 - RNA, 19 nt, Artificial Sequence
  Description of Artificial Sequence: Synthetic oligonucleotide
ucuucgggcaggcuuggcc

SEQ ID NO: 2490 - RNA, 19 nt, Artificial Sequence
  Description of Artificial Sequence: Synthetic oligonucleotide
uucuucgggcaggcuuggc

SEQ ID NO: 2491 - RNA, 19 nt, Artificial Sequence
  Description of Artificial Sequence: Synthetic oligonucleotide
uuucuucgggcaggcuugg

SEQ ID NO: 2492 - RNA, 19 nt, Artificial Sequence
  Description of Artificial Sequence: Synthetic oligonucleotide
cuuucuucgggcaggcuug

SEQ ID NO: 2493 - RNA, 19 nt, Artificial Sequence
  Description of Artificial Sequence: Synthetic oligonucleotide
ucuuucuucgggcaggcuu

SEQ ID NO: 2494 - RNA, 19 nt, Artificial Sequence
  Description of Artificial Sequence: Synthetic oligonucleotide
cucuuucuucgggcaggcu

SEQ ID NO: 2495 - RNA, 19 nt, Artificial Sequence
  Description of Artificial Sequence: Synthetic oligonucleotide
ccucuuucuucgggcaggc

SEQ ID NO: 2496 - RNA, 19 nt, Artificial Sequence
  Description of Artificial Sequence: Synthetic oligonucleotide
gccucuuucuucgggcagg

SEQ ID NO: 2497 - RNA, 19 nt, Artificial Sequence
  Description of Artificial Sequence: Synthetic oligonucleotide
agccucuuucuucgggcag

SEQ ID NO: 2498 - RNA, 19 nt, Artificial Sequence
  Description of Artificial Sequence: Synthetic oligonucleotide
cagccucuuucuucgggca

SEQ ID NO: 2499 - RNA, 19 nt, Artificial Sequence
  Description of Artificial Sequence: Synthetic oligonucleotide
gcagccucuuucuucgggc

SEQ ID NO: 2500 - RNA, 19 nt, Artificial Sequence
  Description of Artificial Sequence: Synthetic oligonucleotide
ggcagccucuuucuucggg

SEQ ID NO: 2501 - RNA, 19 nt, Artificial Sequence
  Description of Artificial Sequence: Synthetic oligonucleotide
gggcagccucuuucuucgg

SEQ ID NO: 2502 - RNA, 19 nt, Artificial Sequence
  Description of Artificial Sequence: Synthetic oligonucleotide
cgggcagccucuuucuucg

SEQ ID NO: 2503 - RNA, 19 nt, Artificial Sequence
  Description of Artificial Sequence: Synthetic oligonucleotide
ucgggcagccucuuucuuc

SEQ ID NO: 2504 - RNA, 19 nt, Artificial Sequence
  Description of Artificial Sequence: Synthetic oligonucleotide
cucgggcagccucuuucuu

SEQ ID NO: 2505 - RNA, 19 nt, Artificial Sequence
  Description of Artificial Sequence: Synthetic oligonucleotide
ucucgggcagccucuuucu

SEQ ID NO: 2506 - RNA, 19 nt, Artificial Sequence
  Description of Artificial Sequence: Synthetic oligonucleotide
aucucgggcagccucuuuc

SEQ ID NO: 2507 - RNA, 19 nt, Artificial Sequence
  Description of Artificial Sequence: Synthetic oligonucleotide
caucucgggcagccucuuu

SEQ ID NO: 2508 - RNA, 19 nt, Artificial Sequence
  Description of Artificial Sequence: Synthetic oligonucleotide
ccaucucgggcagccucuu

SEQ ID NO: 2509 - RNA, 19 nt, Artificial Sequence
  Description of Artificial Sequence: Synthetic oligonucleotide
gccaucucgggcagccucu

SEQ ID NO: 2510 - RNA, 19 nt, Artificial Sequence
  Description of Artificial Sequence: Synthetic oligonucleotide
ggccaucucgggcagccuc

SEQ ID NO: 2511 - RNA, 19 nt, Artificial Sequence
  Description of Artificial Sequence: Synthetic oligonucleotide
gggccaucucgggcagccu

SEQ ID NO: 2512 - RNA, 19 nt, Artificial Sequence
  Description of Artificial Sequence: Synthetic oligonucleotide
ugggccaucucgggcagcc

SEQ ID NO: 2513 - RNA, 19 nt, Artificial Sequence
  Description of Artificial Sequence: Synthetic oligonucleotide
cugggccaucucgggcagc

SEQ ID NO: 2514 - RNA, 19 nt, Artificial Sequence
  Description of Artificial Sequence: Synthetic oligonucleotide
gcugggccaucucgggcag

SEQ ID NO: 2515 - RNA, 19 nt, Artificial Sequence
  Description of Artificial Sequence: Synthetic oligonucleotide
ggcugggccaucucgggca

SEQ ID NO: 2516 - RNA, 19 nt, Artificial Sequence
  Description of Artificial Sequence: Synthetic oligonucleotide
uggcugggccaucucgggc

SEQ ID NO: 2517 - RNA, 19 nt, Artificial Sequence
  Description of Artificial Sequence: Synthetic oligonucleotide
cuggcugggccaucucggg

SEQ ID NO: 2518 - RNA, 19 nt, Artificial Sequence
  Description of Artificial Sequence: Synthetic oligonucleotide
acuggcugggccaucucgg

SEQ ID NO: 2519 - RNA, 19 nt, Artificial Sequence
  Description of Artificial Sequence: Synthetic oligonucleotide
aacuggcugggccaucucg

SEQ ID NO: 2520 - RNA, 19 nt, Artificial Sequence
  Description of Artificial Sequence: Synthetic oligonucleotide
caacuggcugggccaucuc

SEQ ID NO: 2521 - RNA, 19 nt, Artificial Sequence
  Description of Artificial Sequence: Synthetic oligonucleotide
ucaacuggcugggccaucu

SEQ ID NO: 2522 - RNA, 19 nt, Artificial Sequence
  Description of Artificial Sequence: Synthetic oligonucleotide
gucaacuggcugggccauc

SEQ ID NO: 2523 - RNA, 19 nt, Artificial Sequence
  Description of Artificial Sequence: Synthetic oligonucleotide
ggucaacuggcugggccau

SEQ ID NO: 2524 - RNA, 19 nt, Artificial Sequence
  Description of Artificial Sequence: Synthetic oligonucleotide
gggucaacuggcugggcca

SEQ ID NO: 2525 - RNA, 19 nt, Artificial Sequence
  Description of Artificial Sequence: Synthetic oligonucleotide
cgggucaacuggcugggcc

SEQ ID NO: 2526 - RNA, 19 nt, Artificial Sequence
  Description of Artificial Sequence: Synthetic oligonucleotide
ccgggucaacuggcugggc

SEQ ID NO: 2527 - RNA, 19 nt, Artificial Sequence
  Description of Artificial Sequence: Synthetic oligonucleotide
gccgggucaacuggcuggg

SEQ ID NO: 2528 - RNA, 19 nt, Artificial Sequence
  Description of Artificial Sequence: Synthetic oligonucleotide
agccgggucaacuggcugg

SEQ ID NO: 2529 - RNA, 19 nt, Artificial Sequence
  Description of Artificial Sequence: Synthetic oligonucleotide
gagccgggucaacuggcug

SEQ ID NO: 2530 - RNA, 19 nt, Artificial Sequence
  Description of Artificial Sequence: Synthetic oligonucleotide
ugagccgggucaacuggcu

SEQ ID NO: 2531 - RNA, 19 nt, Artificial Sequence
  Description of Artificial Sequence: Synthetic oligonucleotide
gugagccgggucaacuggc

SEQ ID NO: 2532 - RNA, 19 nt, Artificial Sequence
  Description of Artificial Sequence: Synthetic oligonucleotide
ugugagccgggucaacugg

SEQ ID NO: 2533 - RNA, 19 nt, Artificial Sequence
  Description of Artificial Sequence: Synthetic oligonucleotide
uugugagccgggucaacug

SEQ ID NO: 2534 - RNA, 19 nt, Artificial Sequence
  Description of Artificial Sequence: Synthetic oligonucleotide
auugugagccgggucaacu

SEQ ID NO: 2535 - RNA, 19 nt, Artificial Sequence
  Description of Artificial Sequence: Synthetic oligonucleotide
cauugugagccgggucaac

SEQ ID NO: 2536 - RNA, 19 nt, Artificial Sequence
  Description of Artificial Sequence: Synthetic oligonucleotide
acauugugagccgggucaa

SEQ ID NO: 2537 - RNA, 19 nt, Artificial Sequence
  Description of Artificial Sequence: Synthetic oligonucleotide
gacauugugagccggguca

SEQ ID NO: 2538 - RNA, 19 nt, Artificial Sequence
  Description of Artificial Sequence: Synthetic oligonucleotide
ugacauugugagccggguc

SEQ ID NO: 2539 - RNA, 19 nt, Artificial Sequence
  Description of Artificial Sequence: Synthetic oligonucleotide
cugacauugugagccgggu

SEQ ID NO: 2540 - RNA, 19 nt, Artificial Sequence
  Description of Artificial Sequence: Synthetic oligonucleotide
gcugacauugugagccggg

SEQ ID NO: 2541 - RNA, 19 nt, Artificial Sequence
  Description of Artificial Sequence: Synthetic oligonucleotide
ggcugacauugugagccgg

SEQ ID NO: 2542 - RNA, 19 nt, Artificial Sequence
  Description of Artificial Sequence: Synthetic oligonucleotide
cggcugacauugugagccg

SEQ ID NO: 2543 - RNA, 19 nt, Artificial Sequence
  Description of Artificial Sequence: Synthetic oligonucleotide
gcggcugacauugugagcc

SEQ ID NO: 2544 - RNA, 19 nt, Artificial Sequence
  Description of Artificial Sequence: Synthetic oligonucleotide
ggcggcugacauugugagc

SEQ ID NO: 2545 - RNA, 19 nt, Artificial Sequence
  Description of Artificial Sequence: Synthetic oligonucleotide
aggcggcugacauugugag

SEQ ID NO: 2546 - RNA, 19 nt, Artificial Sequence
  Description of Artificial Sequence: Synthetic oligonucleotide
caggcggcugacauuguga

SEQ ID NO: 2547 - RNA, 19 nt, Artificial Sequence
  Description of Artificial Sequence: Synthetic oligonucleotide
gcaggcggcugacauugug

SEQ ID NO: 2548 - RNA, 19 nt, Artificial Sequence
  Description of Artificial Sequence: Synthetic oligonucleotide
ugcaggcggcugacauugu

SEQ ID NO: 2549 - RNA, 19 nt, Artificial Sequence
  Description of Artificial Sequence: Synthetic oligonucleotide
gugcaggcggcugacauug

SEQ ID NO: 2550 - RNA, 19 nt, Artificial Sequence
  Description of Artificial Sequence: Synthetic oligonucleotide
ggugcaggcggcugacauu

SEQ ID NO: 2551 - RNA, 19 nt, Artificial Sequence
  Description of Artificial Sequence: Synthetic oligonucleotide
cggugcaggcggcugacau

SEQ ID NO: 2552 - RNA, 19 nt, Artificial Sequence
  Description of Artificial Sequence: Synthetic oligonucleotide
ccggugcaggcggcugaca

SEQ ID NO: 2553 - RNA, 19 nt, Artificial Sequence
  Description of Artificial Sequence: Synthetic oligonucleotide
gccggugcaggcggcugac

SEQ ID NO: 2554 - RNA, 19 nt, Artificial Sequence
  Description of Artificial Sequence: Synthetic oligonucleotide
agccggugcaggcggcuga

SEQ ID NO: 2555 - RNA, 19 nt, Artificial Sequence
  Description of Artificial Sequence: Synthetic oligonucleotide
cagccggugcaggcggcug

SEQ ID NO: 2556 - RNA, 19 nt, Artificial Sequence
  Description of Artificial Sequence: Synthetic oligonucleotide
gcagccggugcaggcggcu

SEQ ID NO: 2557 - RNA, 19 nt, Artificial Sequence
  Description of Artificial Sequence: Synthetic oligonucleotide
ggcagccggugcaggcggc

SEQ ID NO: 2558 - RNA, 19 nt, Artificial Sequence
  Description of Artificial Sequence: Synthetic oligonucleotide
gggcagccggugcaggcgg

SEQ ID NO: 2559 - RNA, 19 nt, Artificial Sequence
  Description of Artificial Sequence: Synthetic oligonucleotide
ugggcagccggugcaggcg

SEQ ID NO: 2560 - RNA, 19 nt, Artificial Sequence
  Description of Artificial Sequence: Synthetic oligonucleotide
cugggcagccggugcaggc

SEQ ID NO: 2561 - RNA, 19 nt, Artificial Sequence
  Description of Artificial Sequence: Synthetic oligonucleotide
ccugggcagccggugcagg

SEQ ID NO: 2562 - RNA, 19 nt, Artificial Sequence
  Description of Artificial Sequence: Synthetic oligonucleotide
cccugggcagccggugcag

SEQ ID NO: 2563 - RNA, 19 nt, Artificial Sequence
  Description of Artificial Sequence: Synthetic oligonucleotide
ucccugggcagccggugca

SEQ ID NO: 2564 - RNA, 19 nt, Artificial Sequence
  Description of Artificial Sequence: Synthetic oligonucleotide
aucccugggcagccggugc

SEQ ID NO: 2565 - RNA, 19 nt, Artificial Sequence
  Description of Artificial Sequence: Synthetic oligonucleotide
aaucccugggcagccggug

SEQ ID NO: 2566 - RNA, 19 nt, Artificial Sequence
  Description of Artificial Sequence: Synthetic oligonucleotide
caaucccugggcagccggu

SEQ ID NO: 2567 - RNA, 19 nt, Artificial Sequence
  Description of Artificial Sequence: Synthetic oligonucleotide
gcaaucccugggcagccgg

SEQ ID NO: 2568 - RNA, 19 nt, Artificial Sequence
  Description of Artificial Sequence: Synthetic oligonucleotide
ggcaaucccugggcagccg

SEQ ID NO: 2569 - RNA, 19 nt, Artificial Sequence
  Description of Artificial Sequence: Synthetic oligonucleotide
uggcaaucccugggcagcc

SEQ ID NO: 2570 - RNA, 19 nt, Artificial Sequence
  Description of Artificial Sequence: Synthetic oligonucleotide
cuggcaaucccugggcagc

SEQ ID NO: 2571 - RNA, 19 nt, Artificial Sequence
  Description of Artificial Sequence: Synthetic oligonucleotide
ccuggcaaucccugggcag

SEQ ID NO: 2572 - RNA, 19 nt, Artificial Sequence
  Description of Artificial Sequence: Synthetic oligonucleotide
uccuggcaaucccugggca

SEQ ID NO: 2573 - RNA, 19 nt, Artificial Sequence
  Description of Artificial Sequence: Synthetic oligonucleotide
cuccuggcaaucccugggc

SEQ ID NO: 2574 - RNA, 19 nt, Artificial Sequence
  Description of Artificial Sequence: Synthetic oligonucleotide
gcuccuggcaaucccuggg

SEQ ID NO: 2575 - RNA, 19 nt, Artificial Sequence
  Description of Artificial Sequence: Synthetic oligonucleotide
agcuccuggcaaucccugg

SEQ ID NO: 2576 - RNA, 19 nt, Artificial Sequence
  Description of Artificial Sequence: Synthetic oligonucleotide
cagcuccuggcaaucccug

SEQ ID NO: 2577 - RNA, 19 nt, Artificial Sequence
  Description of Artificial Sequence: Synthetic oligonucleotide
acagcuccuggcaaucccu

SEQ ID NO: 2578 - RNA, 19 nt, Artificial Sequence
  Description of Artificial Sequence: Synthetic oligonucleotide
aacagcuccuggcaauccc

SEQ ID NO: 2579 - RNA, 19 nt, Artificial Sequence
  Description of Artificial Sequence: Synthetic oligonucleotide
gaacagcuccuggcaaucc

SEQ ID NO: 2580 - RNA, 19 nt, Artificial Sequence
  Description of Artificial Sequence: Synthetic oligonucleotide
ggaacagcuccuggcaauc

SEQ ID NO: 2581 - RNA, 19 nt, Artificial Sequence
  Description of Artificial Sequence: Synthetic oligonucleotide
uggaacagcuccuggcaau

SEQ ID NO: 2582 - RNA, 19 nt, Artificial Sequence
  Description of Artificial Sequence: Synthetic oligonucleotide
cuggaacagcuccuggcaa

SEQ ID NO: 2583 - RNA, 19 nt, Artificial Sequence
  Description of Artificial Sequence: Synthetic oligonucleotide
ccuggaacagcuccuggca

SEQ ID NO: 2584 - RNA, 19 nt, Artificial Sequence
  Description of Artificial Sequence: Synthetic oligonucleotide
accuggaacagcuccuggc

SEQ ID NO: 2585 - RNA, 19 nt, Artificial Sequence
  Description of Artificial Sequence: Synthetic oligonucleotide
aaccuggaacagcuccugg

SEQ ID NO: 2586 - RNA, 19 nt, Artificial Sequence
  Description of Artificial Sequence: Synthetic oligonucleotide
caaccuggaacagcuccug

SEQ ID NO: 2587 - RNA, 19 nt, Artificial Sequence
  Description of Artificial Sequence: Synthetic oligonucleotide
ccaaccuggaacagcuccu

SEQ ID NO: 2588 - RNA, 19 nt, Artificial Sequence
  Description of Artificial Sequence: Synthetic oligonucleotide
cccaaccuggaacagcucc

SEQ ID NO: 2589 - RNA, 19 nt, Artificial Sequence
  Description of Artificial Sequence: Synthetic oligonucleotide
ccccaaccuggaacagcuc

SEQ ID NO: 2590 - RNA, 19 nt, Artificial Sequence
  Description of Artificial Sequence: Synthetic oligonucleotide
uccccaaccuggaacagcu

SEQ ID NO: 2591 - RNA, 19 nt, Artificial Sequence
  Description of Artificial Sequence: Synthetic oligonucleotide
cuccccaaccuggaacagc

SEQ ID NO: 2592 - RNA, 19 nt, Artificial Sequence
  Description of Artificial Sequence: Synthetic oligonucleotide
ucuccccaaccuggaacag

SEQ ID NO: 2593 - RNA, 19 nt, Artificial Sequence
  Description of Artificial Sequence: Synthetic oligonucleotide
cucuccccaaccuggaaca

SEQ ID NO: 2594 - RNA, 19 nt, Artificial Sequence
  Description of Artificial Sequence: Synthetic oligonucleotide
ccucuccccaaccuggaac

SEQ ID NO: 2595 - RNA, 19 nt, Artificial Sequence
  Description of Artificial Sequence: Synthetic oligonucleotide
gccucuccccaaccuggaa

SEQ ID NO: 2596 - RNA, 19 nt, Artificial Sequence
  Description of Artificial Sequence: Synthetic oligonucleotide
ugccucuccccaaccugga

SEQ ID NO: 2597 - RNA, 19 nt, Artificial Sequence
  Description of Artificial Sequence: Synthetic oligonucleotide
cugccucuccccaaccugg

SEQ ID NO: 2598 - RNA, 19 nt, Artificial Sequence
  Description of Artificial Sequence: Synthetic oligonucleotide
ucugccucuccccaaccug

SEQ ID NO: 2599 - RNA, 19 nt, Artificial Sequence
  Description of Artificial Sequence: Synthetic oligonucleotide
cucugccucuccccaaccu

SEQ ID NO: 2600 - RNA, 19 nt, Artificial Sequence
  Description of Artificial Sequence: Synthetic oligonucleotide
acucugccucuccccaacc

SEQ ID NO: 2601 - RNA, 19 nt, Artificial Sequence
  Description of Artificial Sequence: Synthetic oligonucleotide
cacucugccucuccccaac

SEQ ID NO: 2602 - RNA, 19 nt, Artificial Sequence
  Description of Artificial Sequence: Synthetic oligonucleotide
ccacucugccucuccccaa

SEQ ID NO: 2603 - RNA, 19 nt, Artificial Sequence
  Description of Artificial Sequence: Synthetic oligonucleotide
uccacucugccucucccca

SEQ ID NO: 2604 - RNA, 19 nt, Artificial Sequence
  Description of Artificial Sequence: Synthetic oligonucleotide
guccacucugccucucccc

SEQ ID NO: 2605 - RNA, 19 nt, Artificial Sequence
  Description of Artificial Sequence: Synthetic oligonucleotide
aguccacucugccucuccc

SEQ ID NO: 2606 - RNA, 19 nt, Artificial Sequence
  Description of Artificial Sequence: Synthetic oligonucleotide
uaguccacucugccucucc

SEQ ID NO: 2607 - RNA, 19 nt, Artificial Sequence
  Description of Artificial Sequence: Synthetic oligonucleotide
auaguccacucugccucuc

SEQ ID NO: 2608 - RNA, 19 nt, Artificial Sequence
  Description of Artificial Sequence: Synthetic oligonucleotide
aauaguccacucugccucu

SEQ ID NO: 2609 - RNA, 19 nt, Artificial Sequence
  Description of Artificial Sequence: Synthetic oligonucleotide
aaauaguccacucugccuc

SEQ ID NO: 2610 - RNA, 19 nt, Artificial Sequence
  Description of Artificial Sequence: Synthetic oligonucleotide
caaauaguccacucugccu

SEQ ID NO: 2611 - RNA, 19 nt, Artificial Sequence
  Description of Artificial Sequence: Synthetic oligonucleotide
ucaaauaguccacucugcc

SEQ ID NO: 2612 - RNA, 19 nt, Artificial Sequence
  Description of Artificial Sequence: Synthetic oligonucleotide
uucaaauaguccacucugc

SEQ ID NO: 2613 - RNA, 19 nt, Artificial Sequence
  Description of Artificial Sequence: Synthetic oligonucleotide
uuucaaauaguccacucug

SEQ ID NO: 2614 - RNA, 19 nt, Artificial Sequence
  Description of Artificial Sequence: Synthetic oligonucleotide
auuucaaauaguccacucu

SEQ ID NO: 2615 - RNA, 19 nt, Artificial Sequence
  Description of Artificial Sequence: Synthetic oligonucleotide
gauuucaaauaguccacuc

SEQ ID NO: 2616 - RNA, 19 nt, Artificial Sequence
  Description of Artificial Sequence: Synthetic oligonucleotide
ggauuucaaauaguccacu

SEQ ID NO: 2617 - RNA, 19 nt, Artificial Sequence
  Description of Artificial Sequence: Synthetic oligonucleotide
uggauuucaaauaguccac

SEQ ID NO: 2618 - RNA, 19 nt, Artificial Sequence
  Description of Artificial Sequence: Synthetic oligonucleotide
cuggauuucaaauagucca

SEQ ID NO: 2619 - RNA, 19 nt, Artificial Sequence
  Description of Artificial Sequence: Synthetic oligonucleotide
gcuggauuucaaauagucc

SEQ ID NO: 2620 - RNA, 19 nt, Artificial Sequence
  Description of Artificial Sequence: Synthetic oligonucleotide
ggcuggauuucaaauaguc

SEQ ID NO: 2621 - RNA, 19 nt, Artificial Sequence
  Description of Artificial Sequence: Synthetic oligonucleotide
aggcuggauuucaaauagu

SEQ ID NO: 2622 - RNA, 19 nt, Artificial Sequence
  Description of Artificial Sequence: Synthetic oligonucleotide
gaggcuggauuucaaauag

SEQ ID NO: 2623 - RNA, 19 nt, Artificial Sequence
  Description of Artificial Sequence: Synthetic oligonucleotide
ugaggcuggauuucaaaua

SEQ ID NO: 2624 - RNA, 19 nt, Artificial Sequence
  Description of Artificial Sequence: Synthetic oligonucleotide
cugaggcuggauuucaaau

SEQ ID NO: 2625 - RNA, 19 nt, Artificial Sequence
  Description of Artificial Sequence: Synthetic oligonucleotide
ccugaggcuggauuucaaa

SEQ ID NO: 2626 - RNA, 19 nt, Artificial Sequence
  Description of Artificial Sequence: Synthetic oligonucleotide
cccugaggcuggauuucaa

SEQ ID NO: 2627 - RNA, 19 nt, Artificial Sequence
  Description of Artificial Sequence: Synthetic oligonucleotide
ccccugaggcuggauuuca

SEQ ID NO: 2628 - RNA, 19 nt, Artificial Sequence
  Description of Artificial Sequence: Synthetic oligonucleotide
accccugaggcuggauuuc

SEQ ID NO: 2629 - RNA, 19 nt, Artificial Sequence
  Description of Artificial Sequence: Synthetic oligonucleotide
gaccccugaggcuggauuu

SEQ ID NO: 2630 - RNA, 19 nt, Artificial Sequence
  Description of Artificial Sequence: Synthetic oligonucleotide
agaccccugaggcuggauu

SEQ ID NO: 2631 - RNA, 19 nt, Artificial Sequence
  Description of Artificial Sequence: Synthetic oligonucleotide
gagaccccugaggcuggau

SEQ ID NO: 2632 - RNA, 19 nt, Artificial Sequence
  Description of Artificial Sequence: Synthetic oligonucleotide
ggagaccccugaggcugga

SEQ ID NO: 2633 - RNA, 19 nt, Artificial Sequence
  Description of Artificial Sequence: Synthetic oligonucleotide
cggagaccccugaggcugg

SEQ ID NO: 2634 - RNA, 19 nt, Artificial Sequence
  Description of Artificial Sequence: Synthetic oligonucleotide
gcggagaccccugaggcug

SEQ ID NO: 2635 - RNA, 19 nt, Artificial Sequence
  Description of Artificial Sequence: Synthetic oligonucleotide
ggcggagaccccugaggcu

SEQ ID NO: 2636 - RNA, 19 nt, Artificial Sequence
  Description of Artificial Sequence: Synthetic oligonucleotide
uggcggagaccccugaggc

SEQ ID NO: 2637 - RNA, 19 nt, Artificial Sequence
  Description of Artificial Sequence: Synthetic oligonucleotide
auggcggagaccccugagg

SEQ ID NO: 2638 - RNA, 19 nt, Artificial Sequence
  Description of Artificial Sequence: Synthetic oligonucleotide
aauggcggagaccccugag

SEQ ID NO: 2639 - RNA, 19 nt, Artificial Sequence
  Description of Artificial Sequence: Synthetic oligonucleotide
aaauggcggagaccccuga

SEQ ID NO: 2640 - RNA, 19 nt, Artificial Sequence
  Description of Artificial Sequence: Synthetic oligonucleotide
aaaauggcggagaccccug

SEQ ID NO: 2641 - RNA, 19 nt, Artificial Sequence
  Description of Artificial Sequence: Synthetic oligonucleotide
aaaaauggcggagaccccu

SEQ ID NO: 2642 - RNA, 19 nt, Artificial Sequence
  Description of Artificial Sequence: Synthetic oligonucleotide
caaaaauggcggagacccc

SEQ ID NO: 2643 - RNA, 19 nt, Artificial Sequence
  Description of Artificial Sequence: Synthetic oligonucleotide
ccaaaaauggcggagaccc

SEQ ID NO: 2644 - RNA, 19 nt, Artificial Sequence
  Description of Artificial Sequence: Synthetic oligonucleotide
accaaaaauggcggagacc

SEQ ID NO: 2645 - RNA, 19 nt, Artificial Sequence
  Description of Artificial Sequence: Synthetic oligonucleotide
caccaaaaauggcggagac

SEQ ID NO: 2646 - RNA, 19 nt, Artificial Sequence
  Description of Artificial Sequence: Synthetic oligonucleotide
ucaccaaaaauggcggaga

SEQ ID NO: 2647 - RNA, 19 nt, Artificial Sequence
  Description of Artificial Sequence: Synthetic oligonucleotide
uucaccaaaaauggcggag

SEQ ID NO: 2648 - RNA, 19 nt, Artificial Sequence
  Description of Artificial Sequence: Synthetic oligonucleotide
guucaccaaaaauggcgga

SEQ ID NO: 2649 - RNA, 19 nt, Artificial Sequence
  Description of Artificial Sequence: Synthetic oligonucleotide
aguucaccaaaaauggcgg

SEQ ID NO: 2650 - RNA, 19 nt, Artificial Sequence
  Description of Artificial Sequence: Synthetic oligonucleotide
caguucaccaaaaauggcg

SEQ ID NO: 2651 - RNA, 19 nt, Artificial Sequence
  Description of Artificial Sequence: Synthetic oligonucleotide
gcaguucaccaaaaauggc

SEQ ID NO: 2652 - RNA, 19 nt, Artificial Sequence
  Description of Artificial Sequence: Synthetic oligonucleotide
ugcaguucaccaaaaaugg

SEQ ID NO: 2653 - RNA, 19 nt, Artificial Sequence
  Description of Artificial Sequence: Synthetic oligonucleotide
uugcaguucaccaaaaaug

SEQ ID NO: 2654 - RNA, 19 nt, Artificial Sequence
  Description of Artificial Sequence: Synthetic oligonucleotide
cuugcaguucaccaaaaau

SEQ ID NO: 2655 - RNA, 19 nt, Artificial Sequence
  Description of Artificial Sequence: Synthetic oligonucleotide
ucuugcaguucaccaaaaa

SEQ ID NO: 2656 - RNA, 19 nt, Artificial Sequence
  Description of Artificial Sequence: Synthetic oligonucleotide
aucuugcaguucaccaaaa

SEQ ID NO: 2657 - RNA, 19 nt, Artificial Sequence
  Description of Artificial Sequence: Synthetic oligonucleotide
caucuugcaguucaccaaa

SEQ ID NO: 2658 - RNA, 19 nt, Artificial Sequence
  Description of Artificial Sequence: Synthetic oligonucleotide
ucaucuugcaguucaccaa

SEQ ID NO: 2659 - RNA, 19 nt, Artificial Sequence
  Description of Artificial Sequence: Synthetic oligonucleotide
gucaucuugcaguucacca

SEQ ID NO: 2660 - RNA, 19 nt, Artificial Sequence
  Description of Artificial Sequence: Synthetic oligonucleotide
ggucaucuugcaguucacc

SEQ ID NO: 2661 - RNA, 19 nt, Artificial Sequence
  Description of Artificial Sequence: Synthetic oligonucleotide
aggucaucuugcaguucac

SEQ ID NO: 2662 - RNA, 19 nt, Artificial Sequence
  Description of Artificial Sequence: Synthetic oligonucleotide
gaggucaucuugcaguuca

SEQ ID NO: 2663 - RNA, 19 nt, Artificial Sequence
  Description of Artificial Sequence: Synthetic oligonucleotide
ugaggucaucuugcaguuc

SEQ ID NO: 2664 - RNA, 19 nt, Artificial Sequence
  Description of Artificial Sequence: Synthetic oligonucleotide
cugaggucaucuugcaguu

SEQ ID NO: 2665 - RNA, 19 nt, Artificial Sequence
  Description of Artificial Sequence: Synthetic oligonucleotide
ucugaggucaucuugcagu

SEQ ID NO: 2666 - RNA, 19 nt, Artificial Sequence
  Description of Artificial Sequence: Synthetic oligonucleotide
aucugaggucaucuugcag

SEQ ID NO: 2667 - RNA, 19 nt, Artificial Sequence
  Description of Artificial Sequence: Synthetic oligonucleotide
caucugaggucaucuugca

SEQ ID NO: 2668 - RNA, 19 nt, Artificial Sequence
  Description of Artificial Sequence: Synthetic oligonucleotide
ccaucugaggucaucuugc

SEQ ID NO: 2669 - RNA, 19 nt, Artificial Sequence
  Description of Artificial Sequence: Synthetic oligonucleotide
uccaucugaggucaucuug

SEQ ID NO: 2670 - RNA, 19 nt, Artificial Sequence
  Description of Artificial Sequence: Synthetic oligonucleotide
cuccaucugaggucaucuu

SEQ ID NO: 2671 - RNA, 19 nt, Artificial Sequence
  Description of Artificial Sequence: Synthetic oligonucleotide
ccuccaucugaggucaucu

SEQ ID NO: 2672 - RNA, 19 nt, Artificial Sequence
  Description of Artificial Sequence: Synthetic oligonucleotide
gccuccaucugaggucauc

SEQ ID NO: 2673 - RNA, 19 nt, Artificial Sequence
  Description of Artificial Sequence: Synthetic oligonucleotide
agccuccaucugaggucau

SEQ ID NO: 2674 - RNA, 19 nt, Artificial Sequence
  Description of Artificial Sequence: Synthetic oligonucleotide
cagccuccaucugagguca

SEQ ID NO: 2675 - RNA, 19 nt, Artificial Sequence
  Description of Artificial Sequence: Synthetic oligonucleotide
ccagccuccaucugagguc

SEQ ID NO: 2676 - RNA, 19 nt, Artificial Sequence
  Description of Artificial Sequence: Synthetic oligonucleotide
uccagccuccaucugaggu

SEQ ID NO: 2677 - RNA, 19 nt, Artificial Sequence
  Description of Artificial Sequence: Synthetic oligonucleotide
guccagccuccaucugagg

SEQ ID NO: 2678 - RNA, 19 nt, Artificial Sequence
  Description of Artificial Sequence: Synthetic oligonucleotide
uguccagccuccaucugag

SEQ ID NO: 2679 - RNA, 19 nt, Artificial Sequence
  Description of Artificial Sequence: Synthetic oligonucleotide
cuguccagccuccaucuga

SEQ ID NO: 2680 - RNA, 19 nt, Artificial Sequence
  Description of Artificial Sequence: Synthetic oligonucleotide
acuguccagccuccaucug

SEQ ID NO: 2681 - RNA, 19 nt, Artificial Sequence
  Description of Artificial Sequence: Synthetic oligonucleotide
uacuguccagccuccaucu

SEQ ID NO: 2682 - RNA, 19 nt, Artificial Sequence
  Description of Artificial Sequence: Synthetic oligonucleotide
uuacuguccagccuccauc

SEQ ID NO: 2683 - RNA, 19 nt, Artificial Sequence
  Description of Artificial Sequence: Synthetic oligonucleotide
auuacuguccagccuccau

SEQ ID NO: 2684 - RNA, 19 nt, Artificial Sequence
  Description of Artificial Sequence: Synthetic oligonucleotide
aauuacuguccagccucca

SEQ ID NO: 2685 - RNA, 19 nt, Artificial Sequence
  Description of Artificial Sequence: Synthetic oligonucleotide
gaauuacuguccagccucc

SEQ ID NO: 2686 - RNA, 19 nt, Artificial Sequence
  Description of Artificial Sequence: Synthetic oligonucleotide
ugaauuacuguccagccuc

SEQ ID NO: 2687 - RNA, 19 nt, Artificial Sequence
  Description of Artificial Sequence: Synthetic oligonucleotide
cugaauuacuguccagccu

SEQ ID NO: 2688 - RNA, 19 nt, Artificial Sequence
  Description of Artificial Sequence: Synthetic oligonucleotide
ucugaauuacuguccagcc

SEQ ID NO: 2689 - RNA, 19 nt, Artificial Sequence
  Description of Artificial Sequence: Synthetic oligonucleotide
cucugaauuacuguccagc

SEQ ID NO: 2690 - RNA, 19 nt, Artificial Sequence
  Description of Artificial Sequence: Synthetic oligonucleotide
ccucugaauuacuguccag

SEQ ID NO: 2691 - RNA, 19 nt, Artificial Sequence
  Description of Artificial Sequence: Synthetic oligonucleotide
gccucugaauuacugucca

SEQ ID NO: 2692 - RNA, 19 nt, Artificial Sequence
  Description of Artificial Sequence: Synthetic oligonucleotide
cgccucugaauuacugucc

SEQ ID NO: 2693 - RNA, 19 nt, Artificial Sequence
  Description of Artificial Sequence: Synthetic oligonucleotide
gcgccucugaauuacuguc

SEQ ID NO: 2694 - RNA, 19 nt, Artificial Sequence
  Description of Artificial Sequence: Synthetic oligonucleotide
ggcgccucugaauuacugu

SEQ ID NO: 2695 - RNA, 19 nt, Artificial Sequence
  Description of Artificial Sequence: Synthetic oligonucleotide
uggcgccucugaauuacug

SEQ ID NO: 2696 - RNA, 19 nt, Artificial Sequence
  Description of Artificial Sequence: Synthetic oligonucleotide
guggcgccucugaauuacu

SEQ ID NO: 2697 - RNA, 19 nt, Artificial Sequence
  Description of Artificial Sequence: Synthetic oligonucleotide
cguggcgccucugaauuac

SEQ ID NO: 2698 - RNA, 19 nt, Artificial Sequence
  Description of Artificial Sequence: Synthetic oligonucleotide
ucguggcgccucugaauua

SEQ ID NO: 2699 - RNA, 19 nt, Artificial Sequence
  Description of Artificial Sequence: Synthetic oligonucleotide
aucguggcgccucugaauu

SEQ ID NO: 2700 - RNA, 19 nt, Artificial Sequence
  Description of Artificial Sequence: Synthetic oligonucleotide
caucguggcgccucugaau

SEQ ID NO: 2701 - RNA, 19 nt, Artificial Sequence
  Description of Artificial Sequence: Synthetic oligonucleotide
ccaucguggcgccucugaa

SEQ ID NO: 2702 - RNA, 19 nt, Artificial Sequence
  Description of Artificial Sequence: Synthetic oligonucleotide
gccaucguggcgccucuga

SEQ ID NO: 2703 - RNA, 19 nt, Artificial Sequence
  Description of Artificial Sequence: Synthetic oligonucleotide
agccaucguggcgccucug

SEQ ID NO: 2704 - RNA, 19 nt, Artificial Sequence
  Description of Artificial Sequence: Synthetic oligonucleotide
gagccaucguggcgccucu

SEQ ID NO: 2705 - RNA, 19 nt, Artificial Sequence
  Description of Artificial Sequence: Synthetic oligonucleotide
ugagccaucguggcgccuc

SEQ ID NO: 2706 - RNA, 19 nt, Artificial Sequence
  Description of Artificial Sequence: Synthetic oligonucleotide
cugagccaucguggcgccu

SEQ ID NO: 2707 - RNA, 19 nt, Artificial Sequence
  Description of Artificial Sequence: Synthetic oligonucleotide
acugagccaucguggcgcc

SEQ ID NO: 2708 - RNA, 19 nt, Artificial Sequence
  Description of Artificial Sequence: Synthetic oligonucleotide
cacugagccaucguggcgc

SEQ ID NO: 2709 - RNA, 19 nt, Artificial Sequence
  Description of Artificial Sequence: Synthetic oligonucleotide
ccacugagccaucguggcg

SEQ ID NO: 2710 - RNA, 19 nt, Artificial Sequence
  Description of Artificial Sequence: Synthetic oligonucleotide
uccacugagccaucguggc

SEQ ID NO: 2711 - RNA, 19 nt, Artificial Sequence
  Description of Artificial Sequence: Synthetic oligonucleotide
guccacugagccaucgugg

SEQ ID NO: 2712 - RNA, 19 nt, Artificial Sequence
  Description of Artificial Sequence: Synthetic oligonucleotide
aguccacugagccaucgug

SEQ ID NO: 2713 - RNA, 19 nt, Artificial Sequence
  Description of Artificial Sequence: Synthetic oligonucleotide
aaguccacugagccaucgu

SEQ ID NO: 2714 - RNA, 19 nt, Artificial Sequence
  Description of Artificial Sequence: Synthetic oligonucleotide
gaaguccacugagccaucg

SEQ ID NO: 2715 - RNA, 19 nt, Artificial Sequence
  Description of Artificial Sequence: Synthetic oligonucleotide
ugaaguccacugagccauc

SEQ ID NO: 2716 - RNA, 19 nt, Artificial Sequence
  Description of Artificial Sequence: Synthetic oligonucleotide
uugaaguccacugagccau

SEQ ID NO: 2717 - RNA, 19 nt, Artificial Sequence
  Description of Artificial Sequence: Synthetic oligonucleotide
guugaaguccacugagcca

SEQ ID NO: 2718 - RNA, 19 nt, Artificial Sequence
  Description of Artificial Sequence: Synthetic oligonucleotide
gguugaaguccacugagcc

SEQ ID NO: 2719 - RNA, 19 nt, Artificial Sequence
  Description of Artificial Sequence: Synthetic oligonucleotide
cgguugaaguccacugagc

SEQ ID NO: 2720 - RNA, 19 nt, Artificial Sequence
  Description of Artificial Sequence: Synthetic oligonucleotide
ccgguugaaguccacugag

SEQ ID NO: 2721 - RNA, 19 nt, Artificial Sequence
  Description of Artificial Sequence: Synthetic oligonucleotide
gccgguugaaguccacuga

SEQ ID NO: 2722 - RNA, 19 nt, Artificial Sequence
  Description of Artificial Sequence: Synthetic oligonucleotide
ggccgguugaaguccacug

SEQ ID NO: 2723 - RNA, 19 nt, Artificial Sequence
  Description of Artificial Sequence: Synthetic oligonucleotide
gggccgguugaaguccacu

SEQ ID NO: 2724 - RNA, 19 nt, Artificial Sequence
  Description of Artificial Sequence: Synthetic oligonucleotide
agggccgguugaaguccac

SEQ ID NO: 2725 - RNA, 19 nt, Artificial Sequence
  Description of Artificial Sequence: Synthetic oligonucleotide
cagggccgguugaagucca

SEQ ID NO: 2726 - RNA, 19 nt, Artificial Sequence
  Description of Artificial Sequence: Synthetic oligonucleotide
ccagggccgguugaagucc

SEQ ID NO: 2727 - RNA, 19 nt, Artificial Sequence
  Description of Artificial Sequence: Synthetic oligonucleotide
cccagggccgguugaaguc

SEQ ID NO: 2728 - RNA, 19 nt, Artificial Sequence
  Description of Artificial Sequence: Synthetic oligonucleotide
ucccagggccgguugaagu

SEQ ID NO: 2729 - RNA, 19 nt, Artificial Sequence
  Description of Artificial Sequence: Synthetic oligonucleotide
uucccagggccgguugaag

SEQ ID NO: 2730 - RNA, 19 nt, Artificial Sequence
  Description of Artificial Sequence: Synthetic oligonucleotide
cuucccagggccgguugaa

SEQ ID NO: 2731 - RNA, 19 nt, Artificial Sequence
  Description of Artificial Sequence: Synthetic oligonucleotide
gcuucccagggccgguuga

SEQ ID NO: 2732 - RNA, 19 nt, Artificial Sequence
  Description of Artificial Sequence: Synthetic oligonucleotide
ggcuucccagggccgguug

SEQ ID NO: 2733 - RNA, 19 nt, Artificial Sequence
  Description of Artificial Sequence: Synthetic oligonucleotide
aggcuucccagggccgguu

SEQ ID NO: 2734 - RNA, 19 nt, Artificial Sequence
  Description of Artificial Sequence: Synthetic oligonucleotide
uaggcuucccagggccggu

SEQ ID NO: 2735 - RNA, 19 nt, Artificial Sequence
  Description of Artificial Sequence: Synthetic oligonucleotide
guaggcuucccagggccgg

SEQ ID NO: 2736 - RNA, 19 nt, Artificial Sequence
  Description of Artificial Sequence: Synthetic oligonucleotide
uguaggcuucccagggccg

SEQ ID NO: 2737 - RNA, 19 nt, Artificial Sequence
  Description of Artificial Sequence: Synthetic oligonucleotide
uuguaggcuucccagggcc

SEQ ID NO: 2738 - RNA, 19 nt, Artificial Sequence
  Description of Artificial Sequence: Synthetic oligonucleotide
cuuguaggcuucccagggc

SEQ ID NO: 2739 - RNA, 19 nt, Artificial Sequence
  Description of Artificial Sequence: Synthetic oligonucleotide
ccuuguaggcuucccaggg

SEQ ID NO: 2740 - RNA, 19 nt, Artificial Sequence
  Description of Artificial Sequence: Synthetic oligonucleotide
gccuuguaggcuucccagg

SEQ ID NO: 2741 - RNA, 19 nt, Artificial Sequence
  Description of Artificial Sequence: Synthetic oligonucleotide
cgccuuguaggcuucccag

SEQ ID NO: 2742 - RNA, 19 nt, Artificial Sequence
  Description of Artificial Sequence: Synthetic oligonucleotide
ccgccuuguaggcuuccca

SEQ ID NO: 2743 - RNA, 19 nt, Artificial Sequence
  Description of Artificial Sequence: Synthetic oligonucleotide
cccgccuuguaggcuuccc

SEQ ID NO: 2744 - RNA, 19 nt, Artificial Sequence
  Description of Artificial Sequence: Synthetic oligonucleotide
ccccgccuuguaggcuucc

SEQ ID NO: 2745 - RNA, 19 nt, Artificial Sequence
  Description of Artificial Sequence: Synthetic oligonucleotide
accccgccuuguaggcuuc

SEQ ID NO: 2746 - RNA, 19 nt, Artificial Sequence
  Description of Artificial Sequence: Synthetic oligonucleotide
aaccccgccuuguaggcuu

SEQ ID NO: 2747 - RNA, 19 nt, Artificial Sequence
  Description of Artificial Sequence: Synthetic oligonucleotide
aaaccccgccuuguaggcu

SEQ ID NO: 2748 - RNA, 19 nt, Artificial Sequence
  Description of Artificial Sequence: Synthetic oligonucleotide
caaaccccgccuuguaggc

SEQ ID NO: 2749 - RNA, 19 nt, Artificial Sequence
  Description of Artificial Sequence: Synthetic oligonucleotide
ccaaaccccgccuuguagg

SEQ ID NO: 2750 - RNA, 19 nt, Artificial Sequence
  Description of Artificial Sequence: Synthetic oligonucleotide
cccaaaccccgccuuguag

SEQ ID NO: 2751 - RNA, 19 nt, Artificial Sequence
  Description of Artificial Sequence: Synthetic oligonucleotide
ccccaaaccccgccuugua

SEQ ID NO: 2752 - RNA, 19 nt, Artificial Sequence
  Description of Artificial Sequence: Synthetic oligonucleotide
uccccaaaccccgccuugu

SEQ ID NO: 2753 - RNA, 19 nt, Artificial Sequence
  Description of Artificial Sequence: Synthetic oligonucleotide
auccccaaaccccgccuug

SEQ ID NO: 2754 - RNA, 19 nt, Artificial Sequence
  Description of Artificial Sequence: Synthetic oligonucleotide
gauccccaaaccccgccuu

SEQ ID NO: 2755 - RNA, 19 nt, Artificial Sequence
  Description of Artificial Sequence: Synthetic oligonucleotide
ggauccccaaaccccgccu

SEQ ID NO: 2756 - RNA, 19 nt, Artificial Sequence
  Description of Artificial Sequence: Synthetic oligonucleotide
gggauccccaaaccccgcc

SEQ ID NO: 2757 - RNA, 19 nt, Artificial Sequence
  Description of Artificial Sequence: Synthetic oligonucleotide
ggggauccccaaaccccgc

SEQ ID NO: 2758 - RNA, 19 nt, Artificial Sequence
  Description of Artificial Sequence: Synthetic oligonucleotide
uggggauccccaaaccccg

SEQ ID NO: 2759 - RNA, 19 nt, Artificial Sequence
  Description of Artificial Sequence: Synthetic oligonucleotide
guggggauccccaaacccc

SEQ ID NO: 2760 - RNA, 19 nt, Artificial Sequence
  Description of Artificial Sequence: Synthetic oligonucleotide
cguggggauccccaaaccc

SEQ ID NO: 2761 - RNA, 19 nt, Artificial Sequence
  Description of Artificial Sequence: Synthetic oligonucleotide
ccguggggauccccaaacc

SEQ ID NO: 2762 - RNA, 19 nt, Artificial Sequence
  Description of Artificial Sequence: Synthetic oligonucleotide
gccguggggauccccaaac

SEQ ID NO: 2763 - RNA, 19 nt, Artificial Sequence
  Description of Artificial Sequence: Synthetic oligonucleotide
cgccguggggauccccaaa

SEQ ID NO: 2764 - RNA, 19 nt, Artificial Sequence
  Description of Artificial Sequence: Synthetic oligonucleotide
ucgccguggggauccccaa

SEQ ID NO: 2765 - RNA, 19 nt, Artificial Sequence
  Description of Artificial Sequence: Synthetic oligonucleotide
cucgccguggggaucccca

SEQ ID NO: 2766 - RNA, 19 nt, Artificial Sequence
  Description of Artificial Sequence: Synthetic oligonucleotide
acucgccguggggaucccc

SEQ ID NO: 2767 - RNA, 19 nt, Artificial Sequence
  Description of Artificial Sequence: Synthetic oligonucleotide
aacucgccguggggauccc

SEQ ID NO: 2768 - RNA, 19 nt, Artificial Sequence
  Description of Artificial Sequence: Synthetic oligonucleotide
gaacucgccguggggaucc

SEQ ID NO: 2769 - RNA, 19 nt, Artificial Sequence
  Description of Artificial Sequence: Synthetic oligonucleotide
agaacucgccguggggauc

SEQ ID NO: 2770 - RNA, 19 nt, Artificial Sequence
  Description of Artificial Sequence: Synthetic oligonucleotide
cagaacucgccguggggau

SEQ ID NO: 2771 - RNA, 19 nt, Artificial Sequence
  Description of Artificial Sequence: Synthetic oligonucleotide
ccagaacucgccgugggga

SEQ ID NO: 2772 - RNA, 19 nt, Artificial Sequence
  Description of Artificial Sequence: Synthetic oligonucleotide
gccagaacucgccgugggg

SEQ ID NO: 2773 - RNA, 19 nt, Artificial Sequence
  Description of Artificial Sequence: Synthetic oligonucleotide
agccagaacucgccguggg

SEQ ID NO: 2774 - RNA, 19 nt, Artificial Sequence
  Description of Artificial Sequence: Synthetic oligonucleotide
cagccagaacucgccgugg

SEQ ID NO: 2775 - RNA, 19 nt, Artificial Sequence
  Description of Artificial Sequence: Synthetic oligonucleotide
ccagccagaacucgccgug

SEQ ID NO: 2776 - RNA, 19 nt, Artificial Sequence
  Description of Artificial Sequence: Synthetic oligonucleotide
cccagccagaacucgccgu

SEQ ID NO: 2777 - RNA, 19 nt, Artificial Sequence
  Description of Artificial Sequence: Synthetic oligonucleotide
acccagccagaacucgccg

SEQ ID NO: 2778 - RNA, 19 nt, Artificial Sequence
  Description of Artificial Sequence: Synthetic oligonucleotide
gacccagccagaacucgcc

SEQ ID NO: 2779 - RNA, 19 nt, Artificial Sequence
  Description of Artificial Sequence: Synthetic oligonucleotide
agacccagccagaacucgc

SEQ ID NO: 2780 - RNA, 19 nt, Artificial Sequence
  Description of Artificial Sequence: Synthetic oligonucleotide
cagacccagccagaacucg

SEQ ID NO: 2781 - RNA, 19 nt, Artificial Sequence
  Description of Artificial Sequence: Synthetic oligonucleotide
ccagacccagccagaacuc

SEQ ID NO: 2782 - RNA, 19 nt, Artificial Sequence
  Description of Artificial Sequence: Synthetic oligonucleotide
uccagacccagccagaacu

SEQ ID NO: 2783 - RNA, 19 nt, Artificial Sequence
  Description of Artificial Sequence: Synthetic oligonucleotide
cuccagacccagccagaac

SEQ ID NO: 2784 - RNA, 19 nt, Artificial Sequence
  Description of Artificial Sequence: Synthetic oligonucleotide
ucuccagacccagccagaa

SEQ ID NO: 2785 - RNA, 19 nt, Artificial Sequence
  Description of Artificial Sequence: Synthetic oligonucleotide
uucuccagacccagccaga

SEQ ID NO: 2786 - RNA, 19 nt, Artificial Sequence
  Description of Artificial Sequence: Synthetic oligonucleotide
cuucuccagacccagccag

SEQ ID NO: 2787 - RNA, 19 nt, Artificial Sequence
  Description of Artificial Sequence: Synthetic oligonucleotide
ccuucuccagacccagcca

SEQ ID NO: 2788 - RNA, 19 nt, Artificial Sequence
  Description of Artificial Sequence: Synthetic oligonucleotide
accuucuccagacccagcc

SEQ ID NO: 2789 - RNA, 19 nt, Artificial Sequence
  Description of Artificial Sequence: Synthetic oligonucleotide
caccuucuccagacccagc

SEQ ID NO: 2790 - RNA, 19 nt, Artificial Sequence
  Description of Artificial Sequence: Synthetic oligonucleotide
gcaccuucuccagacccag

SEQ ID NO: 2791 - RNA, 19 nt, Artificial Sequence
  Description of Artificial Sequence: Synthetic oligonucleotide
ugcaccuucuccagaccca

SEQ ID NO: 2792 - RNA, 19 nt, Artificial Sequence
  Description of Artificial Sequence: Synthetic oligonucleotide
augcaccuucuccagaccc

SEQ ID NO: 2793 - RNA, 19 nt, Artificial Sequence
  Description of Artificial Sequence: Synthetic oligonucleotide
uaugcaccuucuccagacc

SEQ ID NO: 2794 - RNA, 19 nt, Artificial Sequence
  Description of Artificial Sequence: Synthetic oligonucleotide
cuaugcaccuucuccagac

SEQ ID NO: 2795 - RNA, 19 nt, Artificial Sequence
  Description of Artificial Sequence: Synthetic oligonucleotide
gcuaugcaccuucuccaga

SEQ ID NO: 2796 - RNA, 19 nt, Artificial Sequence
  Description of Artificial Sequence: Synthetic oligonucleotide
ugcuaugcaccuucuccag

SEQ ID NO: 2797 - RNA, 19 nt, Artificial Sequence
  Description of Artificial Sequence: Synthetic oligonucleotide
augcuaugcaccuucucca

SEQ ID NO: 2798 - RNA, 19 nt, Artificial Sequence
  Description of Artificial Sequence: Synthetic oligonucleotide
gaugcuaugcaccuucucc

SEQ ID NO: 2799 - RNA, 19 nt, Artificial Sequence
  Description of Artificial Sequence: Synthetic oligonucleotide
ugaugcuaugcaccuucuc

SEQ ID NO: 2800 - RNA, 19 nt, Artificial Sequence
  Description of Artificial Sequence: Synthetic oligonucleotide
gugaugcuaugcaccuucu

SEQ ID NO: 2801 - RNA, 19 nt, Artificial Sequence
  Description of Artificial Sequence: Synthetic oligonucleotide
cgugaugcuaugcaccuuc

SEQ ID NO: 2802 - RNA, 19 nt, Artificial Sequence
  Description of Artificial Sequence: Synthetic oligonucleotide
ccgugaugcuaugcaccuu

SEQ ID NO: 2803 - RNA, 19 nt, Artificial Sequence
  Description of Artificial Sequence: Synthetic oligonucleotide
cccgugaugcuaugcaccu

SEQ ID NO: 2804 - RNA, 19 nt, Artificial Sequence
  Description of Artificial Sequence: Synthetic oligonucleotide
ccccgugaugcuaugcacc

SEQ ID NO: 2805 - RNA, 19 nt, Artificial Sequence
  Description of Artificial Sequence: Synthetic oligonucleotide
cccccgugaugcuaugcac

SEQ ID NO: 2806 - RNA, 19 nt, Artificial Sequence
  Description of Artificial Sequence: Synthetic oligonucleotide
ucccccgugaugcuaugca

SEQ ID NO: 2807 - RNA, 19 nt, Artificial Sequence
  Description of Artificial Sequence: Synthetic oligonucleotide
gucccccgugaugcuaugc

SEQ ID NO: 2808 - RNA, 19 nt, Artificial Sequence
  Description of Artificial Sequence: Synthetic oligonucleotide
ggucccccgugaugcuaug

SEQ ID NO: 2809 - RNA, 19 nt, Artificial Sequence
  Description of Artificial Sequence: Synthetic oligonucleotide
cggucccccgugaugcuau

SEQ ID NO: 2810 - RNA, 19 nt, Artificial Sequence
  Description of Artificial Sequence: Synthetic oligonucleotide
gcggucccccgugaugcua

SEQ ID NO: 2811 - RNA, 19 nt, Artificial Sequence
  Description of Artificial Sequence: Synthetic oligonucleotide
ugcggucccccgugaugcu

SEQ ID NO: 2812 - RNA, 19 nt, Artificial Sequence
  Description of Artificial Sequence: Synthetic oligonucleotide
uugcggucccccgugaugc

SEQ ID NO: 2813 - RNA, 19 nt, Artificial Sequence
  Description of Artificial Sequence: Synthetic oligonucleotide
guugcggucccccgugaug

SEQ ID NO: 2814 - RNA, 19 nt, Artificial Sequence
  Description of Artificial Sequence: Synthetic oligonucleotide
uguugcggucccccgugau

SEQ ID NO: 2815 - RNA, 19 nt, Artificial Sequence
  Description of Artificial Sequence: Synthetic oligonucleotide
cuguugcggucccccguga

SEQ ID NO: 2816 - RNA, 19 nt, Artificial Sequence
  Description of Artificial Sequence: Synthetic oligonucleotide
gcuguugcggucccccgug

SEQ ID NO: 2817 - RNA, 19 nt, Artificial Sequence
  Description of Artificial Sequence: Synthetic oligonucleotide
ggcuguugcggucccccgu

SEQ ID NO: 2818 - RNA, 19 nt, Artificial Sequence
  Description of Artificial Sequence: Synthetic oligonucleotide
cggcuguugcggucccccg

SEQ ID NO: 2819 - RNA, 19 nt, Artificial Sequence
  Description of Artificial Sequence: Synthetic oligonucleotide
gcggcuguugcgguccccc

SEQ ID NO: 2820 - RNA, 19 nt, Artificial Sequence
  Description of Artificial Sequence: Synthetic oligonucleotide
ggcggcuguugcggucccc

SEQ ID NO: 2821 - RNA, 19 nt, Artificial Sequence
  Description of Artificial Sequence: Synthetic oligonucleotide
aggcggcuguugcgguccc

SEQ ID NO: 2822 - RNA, 19 nt, Artificial Sequence
  Description of Artificial Sequence: Synthetic oligonucleotide
caggcggcuguugcggucc

SEQ ID NO: 2823 - RNA, 19 nt, Artificial Sequence
  Description of Artificial Sequence: Synthetic oligonucleotide
ccaggcggcuguugcgguc

SEQ ID NO: 2824 - RNA, 19 nt, Artificial Sequence
  Description of Artificial Sequence: Synthetic oligonucleotide
gccaggcggcuguugcggu

SEQ ID NO: 2825 - RNA, 19 nt, Artificial Sequence
  Description of Artificial Sequence: Synthetic oligonucleotide
ggccaggcggcuguugcgg

SEQ ID NO: 2826 - RNA, 19 nt, Artificial Sequence
  Description of Artificial Sequence: Synthetic oligonucleotide
cggccaggcggcuguugcg

SEQ ID NO: 2827 - RNA, 19 nt, Artificial Sequence
  Description of Artificial Sequence: Synthetic oligonucleotide
acggccaggcggcuguugc

SEQ ID NO: 2828 - RNA, 19 nt, Artificial Sequence
  Description of Artificial Sequence: Synthetic oligonucleotide
cacggccaggcggcuguug

SEQ ID NO: 2829 - RNA, 19 nt, Artificial Sequence
  Description of Artificial Sequence: Synthetic oligonucleotide
gcacggccaggcggcuguu

SEQ ID NO: 2830 - RNA, 19 nt, Artificial Sequence
  Description of Artificial Sequence: Synthetic oligonucleotide
ugcacggccaggcggcugu

SEQ ID NO: 2831 - RNA, 19 nt, Artificial Sequence
  Description of Artificial Sequence: Synthetic oligonucleotide
cugcacggccaggcggcug

SEQ ID NO: 2832 - RNA, 19 nt, Artificial Sequence
  Description of Artificial Sequence: Synthetic oligonucleotide
gcugcacggccaggcggcu

SEQ ID NO: 2833 - RNA, 19 nt, Artificial Sequence
  Description of Artificial Sequence: Synthetic oligonucleotide
agcugcacggccaggcggc

SEQ ID NO: 2834 - RNA, 19 nt, Artificial Sequence
  Description of Artificial Sequence: Synthetic oligonucleotide
cagcugcacggccaggcgg

SEQ ID NO: 2835 - RNA, 19 nt, Artificial Sequence
  Description of Artificial Sequence: Synthetic oligonucleotide
gcagcugcacggccaggcg

SEQ ID NO: 2836 - RNA, 19 nt, Artificial Sequence
  Description of Artificial Sequence: Synthetic oligonucleotide
cgcagcugcacggccaggc

SEQ ID NO: 2837 - RNA, 19 nt, Artificial Sequence
  Description of Artificial Sequence: Synthetic oligonucleotide
ccgcagcugcacggccagg

SEQ ID NO: 2838 - RNA, 19 nt, Artificial Sequence
  Description of Artificial Sequence: Synthetic oligonucleotide
cccgcagcugcacggccag

SEQ ID NO: 2839 - RNA, 19 nt, Artificial Sequence
  Description of Artificial Sequence: Synthetic oligonucleotide
ucccgcagcugcacggcca

SEQ ID NO: 2840 - RNA, 19 nt, Artificial Sequence
  Description of Artificial Sequence: Synthetic oligonucleotide
gucccgcagcugcacggcc

SEQ ID NO: 2841 - RNA, 19 nt, Artificial Sequence
  Description of Artificial Sequence: Synthetic oligonucleotide
agucccgcagcugcacggc

SEQ ID NO: 2842 - RNA, 19 nt, Artificial Sequence
  Description of Artificial Sequence: Synthetic oligonucleotide
cagucccgcagcugcacgg

SEQ ID NO: 2843 - RNA, 19 nt, Artificial Sequence
  Description of Artificial Sequence: Synthetic oligonucleotide
ccagucccgcagcugcacg

SEQ ID NO: 2844 - RNA, 19 nt, Artificial Sequence
  Description of Artificial Sequence: Synthetic oligonucleotide
cccagucccgcagcugcac

SEQ ID NO: 2845 - RNA, 19 nt, Artificial Sequence
  Description of Artificial Sequence: Synthetic oligonucleotide
ucccagucccgcagcugca

SEQ ID NO: 2846 - RNA, 19 nt, Artificial Sequence
  Description of Artificial Sequence: Synthetic oligonucleotide
aucccagucccgcagcugc

SEQ ID NO: 2847 - RNA, 19 nt, Artificial Sequence
  Description of Artificial Sequence: Synthetic oligonucleotide
caucccagucccgcagcug

SEQ ID NO: 2848 - RNA, 19 nt, Artificial Sequence
  Description of Artificial Sequence: Synthetic oligonucleotide
ccaucccagucccgcagcu

SEQ ID NO: 2849 - RNA, 19 nt, Artificial Sequence
  Description of Artificial Sequence: Synthetic oligonucleotide
gccaucccagucccgcagc

SEQ ID NO: 2850 - RNA, 19 nt, Artificial Sequence
  Description of Artificial Sequence: Synthetic oligonucleotide
ugccaucccagucccgcag

SEQ ID NO: 2851 - RNA, 19 nt, Artificial Sequence
  Description of Artificial Sequence: Synthetic oligonucleotide
uugccaucccagucccgca

SEQ ID NO: 2852 - RNA, 19 nt, Artificial Sequence
  Description of Artificial Sequence: Synthetic oligonucleotide
guugccaucccagucccgc

SEQ ID NO: 2853 - RNA, 19 nt, Artificial Sequence
  Description of Artificial Sequence: Synthetic oligonucleotide
cguugccaucccagucccg

SEQ ID NO: 2854 - RNA, 19 nt, Artificial Sequence
  Description of Artificial Sequence: Synthetic oligonucleotide
gcguugccaucccaguccc

SEQ ID NO: 2855 - RNA, 19 nt, Artificial Sequence
  Description of Artificial Sequence: Synthetic oligonucleotide
ggcguugccaucccagucc

SEQ ID NO: 2856 - RNA, 19 nt, Artificial Sequence
  Description of Artificial Sequence: Synthetic oligonucleotide
cggcguugccaucccaguc

SEQ ID NO: 2857 - RNA, 19 nt, Artificial Sequence
  Description of Artificial Sequence: Synthetic oligonucleotide
ucggcguugccaucccagu

SEQ ID NO: 2858 - RNA, 19 nt, Artificial Sequence
  Description of Artificial Sequence: Synthetic oligonucleotide
cucggcguugccaucccag

SEQ ID NO: 2859 - RNA, 19 nt, Artificial Sequence
  Description of Artificial Sequence: Synthetic oligonucleotide
acucggcguugccauccca

SEQ ID NO: 2860 - RNA, 19 nt, Artificial Sequence
  Description of Artificial Sequence: Synthetic oligonucleotide
aacucggcguugccauccc

SEQ ID NO: 2861 - RNA, 19 nt, Artificial Sequence
  Description of Artificial Sequence: Synthetic oligonucleotide
caacucggcguugccaucc

SEQ ID NO: 2862 - RNA, 19 nt, Artificial Sequence
  Description of Artificial Sequence: Synthetic oligonucleotide
gcaacucggcguugccauc

SEQ ID NO: 2863 - RNA, 19 nt, Artificial Sequence
  Description of Artificial Sequence: Synthetic oligonucleotide
agcaacucggcguugccau

SEQ ID NO: 2864 - RNA, 19 nt, Artificial Sequence
  Description of Artificial Sequence: Synthetic oligonucleotide
cagcaacucggcguugcca

SEQ ID NO: 2865 - RNA, 19 nt, Artificial Sequence
  Description of Artificial Sequence: Synthetic oligonucleotide
gcagcaacucggcguugcc

SEQ ID NO: 2866 - RNA, 19 nt, Artificial Sequence
  Description of Artificial Sequence: Synthetic oligonucleotide
ugcagcaacucggcguugc

SEQ ID NO: 2867 - RNA, 19 nt, Artificial Sequence
  Description of Artificial Sequence: Synthetic oligonucleotide
cugcagcaacucggcguug

SEQ ID NO: 2868 - RNA, 19 nt, Artificial Sequence
  Description of Artificial Sequence: Synthetic oligonucleotide
acugcagcaacucggcguu

SEQ ID NO: 2869 - RNA, 19 nt, Artificial Sequence
  Description of Artificial Sequence: Synthetic oligonucleotide
aacugcagcaacucggcgu

SEQ ID NO: 2870 - RNA, 19 nt, Artificial Sequence
  Description of Artificial Sequence: Synthetic oligonucleotide
gaacugcagcaacucggcg

SEQ ID NO: 2871 - RNA, 19 nt, Artificial Sequence
  Description of Artificial Sequence: Synthetic oligonucleotide
agaacugcagcaacucggc

SEQ ID NO: 2872 - RNA, 19 nt, Artificial Sequence
  Description of Artificial Sequence: Synthetic oligonucleotide
gagaacugcagcaacucgg

SEQ ID NO: 2873 - RNA, 19 nt, Artificial Sequence
  Description of Artificial Sequence: Synthetic oligonucleotide
ggagaacugcagcaacucg

SEQ ID NO: 2874 - RNA, 19 nt, Artificial Sequence
  Description of Artificial Sequence: Synthetic oligonucleotide
cggagaacugcagcaacuc

SEQ ID NO: 2875 - RNA, 19 nt, Artificial Sequence
  Description of Artificial Sequence: Synthetic oligonucleotide
acggagaacugcagcaacu

SEQ ID NO: 2876 - RNA, 19 nt, Artificial Sequence
  Description of Artificial Sequence: Synthetic oligonucleotide
cacggagaacugcagcaac

SEQ ID NO: 2877 - RNA, 19 nt, Artificial Sequence
  Description of Artificial Sequence: Synthetic oligonucleotide
gcacggagaacugcagcaa

SEQ ID NO: 2878 - RNA, 19 nt, Artificial Sequence
  Description of Artificial Sequence: Synthetic oligonucleotide
ugcacggagaacugcagca

SEQ ID NO: 2879 - RNA, 19 nt, Artificial Sequence
  Description of Artificial Sequence: Synthetic oligonucleotide
gugcacggagaacugcagc

SEQ ID NO: 2880 - RNA, 19 nt, Artificial Sequence
  Description of Artificial Sequence: Synthetic oligonucleotide
ggugcacggagaacugcag

SEQ ID NO: 2881 - RNA, 19 nt, Artificial Sequence
  Description of Artificial Sequence: Synthetic oligonucleotide
aggugcacggagaacugca

SEQ ID NO: 2882 - RNA, 19 nt, Artificial Sequence
  Description of Artificial Sequence: Synthetic oligonucleotide
caggugcacggagaacugc

SEQ ID NO: 2883 - RNA, 19 nt, Artificial Sequence
  Description of Artificial Sequence: Synthetic oligonucleotide
ccaggugcacggagaacug

SEQ ID NO: 2884 - RNA, 19 nt, Artificial Sequence
  Description of Artificial Sequence: Synthetic oligonucleotide
cccaggugcacggagaacu

SEQ ID NO: 2885 - RNA, 19 nt, Artificial Sequence
  Description of Artificial Sequence: Synthetic oligonucleotide
acccaggugcacggagaac

SEQ ID NO: 2886 - RNA, 19 nt, Artificial Sequence
  Description of Artificial Sequence: Synthetic oligonucleotide
cacccaggugcacggagaa

SEQ ID NO: 2887 - RNA, 19 nt, Artificial Sequence
  Description of Artificial Sequence: Synthetic oligonucleotide
ccacccaggugcacggaga

SEQ ID NO: 2888 - RNA, 19 nt, Artificial Sequence
  Description of Artificial Sequence: Synthetic oligonucleotide
gccacccaggugcacggag

SEQ ID NO: 2889 - RNA, 19 nt, Artificial Sequence
  Description of Artificial Sequence: Synthetic oligonucleotide
cgccacccaggugcacgga

SEQ ID NO: 2890 - RNA, 19 nt, Artificial Sequence
  Description of Artificial Sequence: Synthetic oligonucleotide
ucgccacccaggugcacgg

SEQ ID NO: 2891 - RNA, 19 nt, Artificial Sequence
  Description of Artificial Sequence: Synthetic oligonucleotide
cucgccacccaggugcacg

SEQ ID NO: 2892 - RNA, 19 nt, Artificial Sequence
  Description of Artificial Sequence: Synthetic oligonucleotide
ccucgccacccaggugcac

SEQ ID NO: 2893 - RNA, 19 nt, Artificial Sequence
  Description of Artificial Sequence: Synthetic oligonucleotide
uccucgccacccaggugca

SEQ ID NO: 2894 - RNA, 19 nt, Artificial Sequence
  Description of Artificial Sequence: Synthetic oligonucleotide
guccucgccacccaggugc

SEQ ID NO: 2895 - RNA, 19 nt, Artificial Sequence
  Description of Artificial Sequence: Synthetic oligonucleotide
uguccucgccacccaggug

SEQ ID NO: 2896 - RNA, 19 nt, Artificial Sequence
  Description of Artificial Sequence: Synthetic oligonucleotide
guguccucgccacccaggu

SEQ ID NO: 2897 - RNA, 19 nt, Artificial Sequence
  Description of Artificial Sequence: Synthetic oligonucleotide
cguguccucgccacccagg

SEQ ID NO: 2898 - RNA, 19 nt, Artificial Sequence
  Description of Artificial Sequence: Synthetic oligonucleotide
ccguguccucgccacccag

SEQ ID NO: 2899 - RNA, 19 nt, Artificial Sequence
  Description of Artificial Sequence: Synthetic oligonucleotide
gccguguccucgccaccca

SEQ ID NO: 2900 - RNA, 19 nt, Artificial Sequence
  Description of Artificial Sequence: Synthetic oligonucleotide
ggccguguccucgccaccc

SEQ ID NO: 2901 - RNA, 19 nt, Artificial Sequence
  Description of Artificial Sequence: Synthetic oligonucleotide
aggccguguccucgccacc

SEQ ID NO: 2902 - RNA, 19 nt, Artificial Sequence
  Description of Artificial Sequence: Synthetic oligonucleotide
uaggccguguccucgccac

SEQ ID NO: 2903 - RNA, 19 nt, Artificial Sequence
  Description of Artificial Sequence: Synthetic oligonucleotide
auaggccguguccucgcca

SEQ ID NO: 2904 - RNA, 19 nt, Artificial Sequence
  Description of Artificial Sequence: Synthetic oligonucleotide
uauaggccguguccucgcc

SEQ ID NO: 2905 - RNA, 19 nt, Artificial Sequence
  Description of Artificial Sequence: Synthetic oligonucleotide
cuauaggccguguccucgc

SEQ ID NO: 2906 - RNA, 19 nt, Artificial Sequence
  Description of Artificial Sequence: Synthetic oligonucleotide
gcuauaggccguguccucg

SEQ ID NO: 2907 - RNA, 19 nt, Artificial Sequence
  Description of Artificial Sequence: Synthetic oligonucleotide
ggcuauaggccguguccuc

SEQ ID NO: 2908 - RNA, 19 nt, Artificial Sequence
  Description of Artificial Sequence: Synthetic oligonucleotide
aggcuauaggccguguccu

SEQ ID NO: 2909 - RNA, 19 nt, Artificial Sequence
  Description of Artificial Sequence: Synthetic oligonucleotide
caggcuauaggccgugucc

SEQ ID NO: 2910 - RNA, 19 nt, Artificial Sequence
  Description of Artificial Sequence: Synthetic oligonucleotide
gcaggcuauaggccguguc

SEQ ID NO: 2911 - RNA, 19 nt, Artificial Sequence
  Description of Artificial Sequence: Synthetic oligonucleotide
ugcaggcuauaggccgugu

SEQ ID NO: 2912 - RNA, 19 nt, Artificial Sequence
  Description of Artificial Sequence: Synthetic oligonucleotide
cugcaggcuauaggccgug

SEQ ID NO: 2913 - RNA, 19 nt, Artificial Sequence
  Description of Artificial Sequence: Synthetic oligonucleotide
gcugcaggcuauaggccgu

SEQ ID NO: 2914 - RNA, 19 nt, Artificial Sequence
  Description of Artificial Sequence: Synthetic oligonucleotide
agcugcaggcuauaggccg

SEQ ID NO: 2915 - RNA, 19 nt, Artificial Sequence
  Description of Artificial Sequence: Synthetic oligonucleotide
gagcugcaggcuauaggcc

SEQ ID NO: 2916 - RNA, 19 nt, Artificial Sequence
  Description of Artificial Sequence: Synthetic oligonucleotide
ugagcugcaggcuauaggc

SEQ ID NO: 2917 - RNA, 19 nt, Artificial Sequence
  Description of Artificial Sequence: Synthetic oligonucleotide
gugagcugcaggcuauagg

SEQ ID NO: 2918 - RNA, 19 nt, Artificial Sequence
  Description of Artificial Sequence: Synthetic oligonucleotide
agugagcugcaggcuauag

SEQ ID NO: 2919 - RNA, 19 nt, Artificial Sequence
  Description of Artificial Sequence: Synthetic oligonucleotide
cagugagcugcaggcuaua

SEQ ID NO: 2920 - RNA, 19 nt, Artificial Sequence
  Description of Artificial Sequence: Synthetic oligonucleotide
gcagugagcugcaggcuau

SEQ ID NO: 2921 - RNA, 19 nt, Artificial Sequence
  Description of Artificial Sequence: Synthetic oligonucleotide
ugcagugagcugcaggcua

SEQ ID NO: 2922 - RNA, 19 nt, Artificial Sequence
  Description of Artificial Sequence: Synthetic oligonucleotide
gugcagugagcugcaggcu

SEQ ID NO: 2923 - RNA, 19 nt, Artificial Sequence
  Description of Artificial Sequence: Synthetic oligonucleotide
ggugcagugagcugcaggc

SEQ ID NO: 2924 - RNA, 19 nt, Artificial Sequence
  Description of Artificial Sequence: Synthetic oligonucleotide
gggugcagugagcugcagg

SEQ ID NO: 2925 - RNA, 19 nt, Artificial Sequence
  Description of Artificial Sequence: Synthetic oligonucleotide
cgggugcagugagcugcag

SEQ ID NO: 2926 - RNA, 19 nt, Artificial Sequence
  Description of Artificial Sequence: Synthetic oligonucleotide
acgggugcagugagcugca

SEQ ID NO: 2927 - RNA, 19 nt, Artificial Sequence
  Description of Artificial Sequence: Synthetic oligonucleotide
cacgggugcagugagcugc

SEQ ID NO: 2928 - RNA, 19 nt, Artificial Sequence
  Description of Artificial Sequence: Synthetic oligonucleotide
ccacgggugcagugagcug

SEQ ID NO: 2929 - RNA, 19 nt, Artificial Sequence
  Description of Artificial Sequence: Synthetic oligonucleotide
gccacgggugcagugagcu

SEQ ID NO: 2930 - RNA, 19 nt, Artificial Sequence
  Description of Artificial Sequence: Synthetic oligonucleotide
ggccacgggugcagugagc

SEQ ID NO: 2931 - RNA, 19 nt, Artificial Sequence
  Description of Artificial Sequence: Synthetic oligonucleotide
cggccacgggugcagugag

SEQ ID NO: 2932 - RNA, 19 nt, Artificial Sequence
  Description of Artificial Sequence: Synthetic oligonucleotide
ccggccacgggugcaguga

SEQ ID NO: 2933 - RNA, 19 nt, Artificial Sequence
  Description of Artificial Sequence: Synthetic oligonucleotide
gccggccacgggugcagug

SEQ ID NO: 2934 - RNA, 19 nt, Artificial Sequence
  Description of Artificial Sequence: Synthetic oligonucleotide
ggccggccacgggugcagu

SEQ ID NO: 2935 - RNA, 19 nt, Artificial Sequence
  Description of Artificial Sequence: Synthetic oligonucleotide
uggccggccacgggugcag

SEQ ID NO: 2936 - RNA, 19 nt, Artificial Sequence
  Description of Artificial Sequence: Synthetic oligonucleotide
cuggccggccacgggugca

SEQ ID NO: 2937 - RNA, 19 nt, Artificial Sequence
  Description of Artificial Sequence: Synthetic oligonucleotide
gcuggccggccacgggugc

SEQ ID NO: 2938 - RNA, 19 nt, Artificial Sequence
  Description of Artificial Sequence: Synthetic oligonucleotide
agcuggccggccacgggug

SEQ ID NO: 2939 - RNA, 19 nt, Artificial Sequence
  Description of Artificial Sequence: Synthetic oligonucleotide
cagcuggccggccacgggu

SEQ ID NO: 2940 - RNA, 19 nt, Artificial Sequence
  Description of Artificial Sequence: Synthetic oligonucleotide
ccagcuggccggccacggg

SEQ ID NO: 2941 - RNA, 19 nt, Artificial Sequence
  Description of Artificial Sequence: Synthetic oligonucleotide
cccagcuggccggccacgg

SEQ ID NO: 2942 - RNA, 19 nt, Artificial Sequence
  Description of Artificial Sequence: Synthetic oligonucleotide
gcccagcuggccggccacg

SEQ ID NO: 2943 - RNA, 19 nt, Artificial Sequence
  Description of Artificial Sequence: Synthetic oligonucleotide
cgcccagcuggccggccac

SEQ ID NO: 2944 - RNA, 19 nt, Artificial Sequence
  Description of Artificial Sequence: Synthetic oligonucleotide
gcgcccagcuggccggcca

SEQ ID NO: 2945 - RNA, 19 nt, Artificial Sequence
  Description of Artificial Sequence: Synthetic oligonucleotide
ggcgcccagcuggccggcc

SEQ ID NO: 2946 - RNA, 19 nt, Artificial Sequence
  Description of Artificial Sequence: Synthetic oligonucleotide
uggcgcccagcuggccggc

SEQ ID NO: 2947 - RNA, 19 nt, Artificial Sequence
  Description of Artificial Sequence: Synthetic oligonucleotide
guggcgcccagcuggccgg

SEQ ID NO: 2948 - RNA, 19 nt, Artificial Sequence
  Description of Artificial Sequence: Synthetic oligonucleotide
gguggcgcccagcuggccg

SEQ ID NO: 2949 - RNA, 19 nt, Artificial Sequence
  Description of Artificial Sequence: Synthetic oligonucleotide
ugguggcgcccagcuggcc

SEQ ID NO: 2950 - RNA, 19 nt, Artificial Sequence
  Description of Artificial Sequence: Synthetic oligonucleotide
gugguggcgcccagcuggc

SEQ ID NO: 2951 - RNA, 19 nt, Artificial Sequence
  Description of Artificial Sequence: Synthetic oligonucleotide
ggugguggcgcccagcugg

SEQ ID NO: 2952 - RNA, 19 nt, Artificial Sequence
  Description of Artificial Sequence: Synthetic oligonucleotide
cggugguggcgcccagcug

SEQ ID NO: 2953 - RNA, 19 nt, Artificial Sequence
  Description of Artificial Sequence: Synthetic oligonucleotide
acggugguggcgcccagcu

SEQ ID NO: 2954 - RNA, 19 nt, Artificial Sequence
  Description of Artificial Sequence: Synthetic oligonucleotide
gacggugguggcgcccagc

SEQ ID NO: 2955 - RNA, 19 nt, Artificial Sequence
  Description of Artificial Sequence: Synthetic oligonucleotide
ggacggugguggcgcccag

SEQ ID NO: 2956 - RNA, 19 nt, Artificial Sequence
  Description of Artificial Sequence: Synthetic oligonucleotide
gggacggugguggcgccca

SEQ ID NO: 2957 - RNA, 19 nt, Artificial Sequence
  Description of Artificial Sequence: Synthetic oligonucleotide
ugggacggugguggcgccc

SEQ ID NO: 2958 - RNA, 19 nt, Artificial Sequence
  Description of Artificial Sequence: Synthetic oligonucleotide
gugggacggugguggcgcc

SEQ ID NO: 2959 - RNA, 19 nt, Artificial Sequence
  Description of Artificial Sequence: Synthetic oligonucleotide
ggugggacggugguggcgc

SEQ ID NO: 2960 - RNA, 19 nt, Artificial Sequence
  Description of Artificial Sequence: Synthetic oligonucleotide
gggugggacggugguggcg

SEQ ID NO: 2961 - RNA, 19 nt, Artificial Sequence
  Description of Artificial Sequence: Synthetic oligonucleotide
ugggugggacggugguggc

SEQ ID NO: 2962 - RNA, 19 nt, Artificial Sequence
  Description of Artificial Sequence: Synthetic oligonucleotide
cugggugggacgguggugg

SEQ ID NO: 2963 - RNA, 19 nt, Artificial Sequence
  Description of Artificial Sequence: Synthetic oligonucleotide
gcugggugggacgguggug

SEQ ID NO: 2964 - RNA, 19 nt, Artificial Sequence
  Description of Artificial Sequence: Synthetic oligonucleotide
cgcugggugggacgguggu

SEQ ID NO: 2965 - RNA, 19 nt, Artificial Sequence
  Description of Artificial Sequence: Synthetic oligonucleotide
ccgcugggugggacggugg

SEQ ID NO: 2966 - RNA, 19 nt, Artificial Sequence
  Description of Artificial Sequence: Synthetic oligonucleotide
gccgcugggugggacggug

SEQ ID NO: 2967 - RNA, 19 nt, Artificial Sequence
  Description of Artificial Sequence: Synthetic oligonucleotide
ggccgcugggugggacggu

SEQ ID NO: 2968 - RNA, 19 nt, Artificial Sequence
  Description of Artificial Sequence: Synthetic oligonucleotide
aggccgcugggugggacgg

SEQ ID NO: 2969 - RNA, 19 nt, Artificial Sequence
  Description of Artificial Sequence: Synthetic oligonucleotide
gaggccgcugggugggacg

SEQ ID NO: 2970 - RNA, 19 nt, Artificial Sequence
  Description of Artificial Sequence: Synthetic oligonucleotide
agaggccgcugggugggac

SEQ ID NO: 2971 - RNA, 19 nt, Artificial Sequence
  Description of Artificial Sequence: Synthetic oligonucleotide
gagaggccgcuggguggga

SEQ ID NO: 2972 - RNA, 19 nt, Artificial Sequence
  Description of Artificial Sequence: Synthetic oligonucleotide
ggagaggccgcuggguggg

SEQ ID NO: 2973 - RNA, 19 nt, Artificial Sequence
  Description of Artificial Sequence: Synthetic oligonucleotide
cggagaggccgcugggugg

SEQ ID NO: 2974 - RNA, 19 nt, Artificial Sequence
  Description of Artificial Sequence: Synthetic oligonucleotide
acggagaggccgcugggug

SEQ ID NO: 2975 - RNA, 19 nt, Artificial Sequence
  Description of Artificial Sequence: Synthetic oligonucleotide
uacggagaggccgcugggu

SEQ ID NO: 2976 - RNA, 19 nt, Artificial Sequence
  Description of Artificial Sequence: Synthetic oligonucleotide
guacggagaggccgcuggg

SEQ ID NO: 2977 - RNA, 19 nt, Artificial Sequence
  Description of Artificial Sequence: Synthetic oligonucleotide
gguacggagaggccgcugg

SEQ ID NO: 2978 - RNA, 19 nt, Artificial Sequence
  Description of Artificial Sequence: Synthetic oligonucleotide
ggguacggagaggccgcug

SEQ ID NO: 2979 - RNA, 19 nt, Artificial Sequence
  Description of Artificial Sequence: Synthetic oligonucleotide
aggguacggagaggccgcu

SEQ ID NO: 2980 - RNA, 19 nt, Artificial Sequence
  Description of Artificial Sequence: Synthetic oligonucleotide
aaggguacggagaggccgc

SEQ ID NO: 2981 - RNA, 19 nt, Artificial Sequence
  Description of Artificial Sequence: Synthetic oligonucleotide
gaaggguacggagaggccg

SEQ ID NO: 2982 - RNA, 19 nt, Artificial Sequence
  Description of Artificial Sequence: Synthetic oligonucleotide
agaaggguacggagaggcc

SEQ ID NO: 2983 - RNA, 19 nt, Artificial Sequence
  Description of Artificial Sequence: Synthetic oligonucleotide
gagaaggguacggagaggc

SEQ ID NO: 2984 - RNA, 19 nt, Artificial Sequence
  Description of Artificial Sequence: Synthetic oligonucleotide
ggagaaggguacggagagg

SEQ ID NO: 2985 - RNA, 19 nt, Artificial Sequence
  Description of Artificial Sequence: Synthetic oligonucleotide
uggagaaggguacggagag

SEQ ID NO: 2986 - RNA, 19 nt, Artificial Sequence
  Description of Artificial Sequence: Synthetic oligonucleotide
guggagaaggguacggaga

SEQ ID NO: 2987 - RNA, 19 nt, Artificial Sequence
  Description of Artificial Sequence: Synthetic oligonucleotide
aguggagaaggguacggag

SEQ ID NO: 2988 - RNA, 19 nt, Artificial Sequence
  Description of Artificial Sequence: Synthetic oligonucleotide
aaguggagaaggguacgga

SEQ ID NO: 2989 - RNA, 19 nt, Artificial Sequence
  Description of Artificial Sequence: Synthetic oligonucleotide
caaguggagaaggguacgg

SEQ ID NO: 2990 - RNA, 19 nt, Artificial Sequence
  Description of Artificial Sequence: Synthetic oligonucleotide
ccaaguggagaaggguacg

SEQ ID NO: 2991 - RNA, 19 nt, Artificial Sequence
  Description of Artificial Sequence: Synthetic oligonucleotide
cccaaguggagaaggguac

SEQ ID NO: 2992 - RNA, 19 nt, Artificial Sequence
  Description of Artificial Sequence: Synthetic oligonucleotide
ucccaaguggagaagggua

SEQ ID NO: 2993 - RNA, 19 nt, Artificial Sequence
  Description of Artificial Sequence: Synthetic oligonucleotide
gucccaaguggagaagggu

SEQ ID NO: 2994 - RNA, 19 nt, Artificial Sequence
  Description of Artificial Sequence: Synthetic oligonucleotide
ggucccaaguggagaaggg

SEQ ID NO: 2995 - RNA, 19 nt, Artificial Sequence
  Description of Artificial Sequence: Synthetic oligonucleotide
uggucccaaguggagaagg

SEQ ID NO: 2996 - RNA, 19 nt, Artificial Sequence
  Description of Artificial Sequence: Synthetic oligonucleotide
cuggucccaaguggagaag

SEQ ID NO: 2997 - RNA, 19 nt, Artificial Sequence
  Description of Artificial Sequence: Synthetic oligonucleotide
ccuggucccaaguggagaa

SEQ ID NO: 2998 - RNA, 19 nt, Artificial Sequence
  Description of Artificial Sequence: Synthetic oligonucleotide
uccuggucccaaguggaga

SEQ ID NO: 2999 - RNA, 19 nt, Artificial Sequence
  Description of Artificial Sequence: Synthetic oligonucleotide
auccuggucccaaguggag

SEQ ID NO: 3000 - RNA, 19 nt, Artificial Sequence
  Description of Artificial Sequence: Synthetic oligonucleotide
gauccuggucccaagugga

SEQ ID NO: 3001 - RNA, 19 nt, Artificial Sequence
  Description of Artificial Sequence: Synthetic oligonucleotide
ugauccuggucccaagugg

SEQ ID NO: 3002 - RNA, 19 nt, Artificial Sequence
  Description of Artificial Sequence: Synthetic oligonucleotide
gugauccuggucccaagug

SEQ ID NO: 3003 - RNA, 19 nt, Artificial Sequence
  Description of Artificial Sequence: Synthetic oligonucleotide
cgugauccuggucccaagu

SEQ ID NO: 3004 - RNA, 19 nt, Artificial Sequence
  Description of Artificial Sequence: Synthetic oligonucleotide
ucgugauccuggucccaag

SEQ ID NO: 3005 - RNA, 19 nt, Artificial Sequence
  Description of Artificial Sequence: Synthetic oligonucleotide
gucgugauccuggucccaa

SEQ ID NO: 3006 - RNA, 19 nt, Artificial Sequence
  Description of Artificial Sequence: Synthetic oligonucleotide
ggucgugauccugguccca

SEQ ID NO: 3007 - RNA, 19 nt, Artificial Sequence
  Description of Artificial Sequence: Synthetic oligonucleotide
aggucgugauccugguccc

SEQ ID NO: 3008 - RNA, 19 nt, Artificial Sequence
  Description of Artificial Sequence: Synthetic oligonucleotide
gaggucgugauccuggucc

SEQ ID NO: 3009 - RNA, 19 nt, Artificial Sequence
  Description of Artificial Sequence: Synthetic oligonucleotide
ggaggucgugauccugguc

SEQ ID NO: 3010 - RNA, 19 nt, Artificial Sequence
  Description of Artificial Sequence: Synthetic oligonucleotide
cggaggucgugauccuggu

SEQ ID NO: 3011 - RNA, 19 nt, Artificial Sequence
  Description of Artificial Sequence: Synthetic oligonucleotide
gcggaggucgugauccugg

SEQ ID NO: 3012 - RNA, 19 nt, Artificial Sequence
  Description of Artificial Sequence: Synthetic oligonucleotide
ugcggaggucgugauccug

SEQ ID NO: 3013 - RNA, 19 nt, Artificial Sequence
  Description of Artificial Sequence: Synthetic oligonucleotide
cugcggaggucgugauccu

SEQ ID NO: 3014 - RNA, 19 nt, Artificial Sequence
  Description of Artificial Sequence: Synthetic oligonucleotide
ccugcggaggucgugaucc

SEQ ID NO: 3015 - RNA, 19 nt, Artificial Sequence
  Description of Artificial Sequence: Synthetic oligonucleotide
cccugcggaggucgugauc

SEQ ID NO: 3016 - RNA, 19 nt, Artificial Sequence
  Description of Artificial Sequence: Synthetic oligonucleotide
ucccugcggaggucgugau

SEQ ID NO: 3017 - RNA, 19 nt, Artificial Sequence
  Description of Artificial Sequence: Synthetic oligonucleotide
gucccugcggaggucguga

SEQ ID NO: 3018 - RNA, 19 nt, Artificial Sequence
  Description of Artificial Sequence: Synthetic oligonucleotide
ugucccugcggaggucgug

SEQ ID NO: 3019 - RNA, 19 nt, Artificial Sequence
  Description of Artificial Sequence: Synthetic oligonucleotide
uugucccugcggaggucgu

SEQ ID NO: 3020 - RNA, 19 nt, Artificial Sequence
  Description of Artificial Sequence: Synthetic oligonucleotide
cuugucccugcggaggucg

SEQ ID NO: 3021 - RNA, 19 nt, Artificial Sequence
  Description of Artificial Sequence: Synthetic oligonucleotide
ucuugucccugcggagguc

SEQ ID NO: 3022 - RNA, 19 nt, Artificial Sequence
  Description of Artificial Sequence: Synthetic oligonucleotide
uucuugucccugcggaggu

SEQ ID NO: 3023 - RNA, 19 nt, Artificial Sequence
  Description of Artificial Sequence: Synthetic oligonucleotide
guucuugucccugcggagg

SEQ ID NO: 3024 - RNA, 19 nt, Artificial Sequence
  Description of Artificial Sequence: Synthetic oligonucleotide
aguucuugucccugcggag

SEQ ID NO: 3025 - RNA, 19 nt, Artificial Sequence
  Description of Artificial Sequence: Synthetic oligonucleotide
caguucuugucccugcgga

SEQ ID NO: 3026 - RNA, 19 nt, Artificial Sequence
  Description of Artificial Sequence: Synthetic oligonucleotide
gcaguucuugucccugcgg

SEQ ID NO: 3027 - RNA, 19 nt, Artificial Sequence
  Description of Artificial Sequence: Synthetic oligonucleotide
cgcaguucuugucccugcg

SEQ ID NO: 3028 - RNA, 19 nt, Artificial Sequence
  Description of Artificial Sequence: Synthetic oligonucleotide
gcgcaguucuugucccugc

SEQ ID NO: 3029 - RNA, 19 nt, Artificial Sequence
  Description of Artificial Sequence: Synthetic oligonucleotide
ggcgcaguucuugucccug

SEQ ID NO: 3030 - RNA, 19 nt, Artificial Sequence
  Description of Artificial Sequence: Synthetic oligonucleotide
uggcgcaguucuugucccu

SEQ ID NO: 3031 - RNA, 19 nt, Artificial Sequence
  Description of Artificial Sequence: Synthetic oligonucleotide
uuggcgcaguucuuguccc

SEQ ID NO: 3032 - RNA, 19 nt, Artificial Sequence
  Description of Artificial Sequence: Synthetic oligonucleotide
cuuggcgcaguucuugucc

SEQ ID NO: 3033 - RNA, 19 nt, Artificial Sequence
  Description of Artificial Sequence: Synthetic oligonucleotide
ucuuggcgcaguucuuguc

SEQ ID NO: 3034 - RNA, 19 nt, Artificial Sequence
  Description of Artificial Sequence: Synthetic oligonucleotide
cucuuggcgcaguucuugu

SEQ ID NO: 3035 - RNA, 19 nt, Artificial Sequence
  Description of Artificial Sequence: Synthetic oligonucleotide
gcucuuggcgcaguucuug

SEQ ID NO: 3036 - RNA, 19 nt, Artificial Sequence
  Description of Artificial Sequence: Synthetic oligonucleotide
ggcucuuggcgcaguucuu

SEQ ID NO: 3037 - RNA, 19 nt, Artificial Sequence
  Description of Artificial Sequence: Synthetic oligonucleotide
aggcucuuggcgcaguucu

SEQ ID NO: 3038 - RNA, 19 nt, Artificial Sequence
  Description of Artificial Sequence: Synthetic oligonucleotide
gaggcucuuggcgcaguuc

SEQ ID NO: 3039 - RNA, 19 nt, Artificial Sequence
  Description of Artificial Sequence: Synthetic oligonucleotide
agaggcucuuggcgcaguu

SEQ ID NO: 3040 - RNA, 19 nt, Artificial Sequence
  Description of Artificial Sequence: Synthetic oligonucleotide
gagaggcucuuggcgcagu

SEQ ID NO: 3041 - RNA, 19 nt, Artificial Sequence
  Description of Artificial Sequence: Synthetic oligonucleotide
agagaggcucuuggcgcag

SEQ ID NO: 3042 - RNA, 19 nt, Artificial Sequence
  Description of Artificial Sequence: Synthetic oligonucleotide
cagagaggcucuuggcgca

SEQ ID NO: 3043 - RNA, 19 nt, Artificial Sequence
  Description of Artificial Sequence: Synthetic oligonucleotide
ccagagaggcucuuggcgc

SEQ ID NO: 3044 - RNA, 19 nt, Artificial Sequence
  Description of Artificial Sequence: Synthetic oligonucleotide
uccagagaggcucuuggcg

SEQ ID NO: 3045 - RNA, 19 nt, Artificial Sequence
  Description of Artificial Sequence: Synthetic oligonucleotide
cuccagagaggcucuuggc

SEQ ID NO: 3046 - RNA, 19 nt, Artificial Sequence
  Description of Artificial Sequence: Synthetic oligonucleotide
ccuccagagaggcucuugg

SEQ ID NO: 3047 - RNA, 19 nt, Artificial Sequence
  Description of Artificial Sequence: Synthetic oligonucleotide
gccuccagagaggcucuug

SEQ ID NO: 3048 - RNA, 19 nt, Artificial Sequence
  Description of Artificial Sequence: Synthetic oligonucleotide
agccuccagagaggcucuu

SEQ ID NO: 3049 - RNA, 19 nt, Artificial Sequence
  Description of Artificial Sequence: Synthetic oligonucleotide
cagccuccagagaggcucu

SEQ ID NO: 3050 - RNA, 19 nt, Artificial Sequence
  Description of Artificial Sequence: Synthetic oligonucleotide
ccagccuccagagaggcuc

SEQ ID NO: 3051 - RNA, 19 nt, Artificial Sequence
  Description of Artificial Sequence: Synthetic oligonucleotide
accagccuccagagaggcu

SEQ ID NO: 3052 - RNA, 19 nt, Artificial Sequence
  Description of Artificial Sequence: Synthetic oligonucleotide
caccagccuccagagaggc

SEQ ID NO: 3053 - RNA, 19 nt, Artificial Sequence
  Description of Artificial Sequence: Synthetic oligonucleotide
ccaccagccuccagagagg

SEQ ID NO: 3054 - RNA, 19 nt, Artificial Sequence
  Description of Artificial Sequence: Synthetic oligonucleotide
accaccagccuccagagag

SEQ ID NO: 3055 - RNA, 19 nt, Artificial Sequence
  Description of Artificial Sequence: Synthetic oligonucleotide
aaccaccagccuccagaga

SEQ ID NO: 3056 - RNA, 19 nt, Artificial Sequence
  Description of Artificial Sequence: Synthetic oligonucleotide
aaaccaccagccuccagag

SEQ ID NO: 3057 - RNA, 19 nt, Artificial Sequence
  Description of Artificial Sequence: Synthetic oligonucleotide
caaaccaccagccuccaga

SEQ ID NO: 3058 - RNA, 19 nt, Artificial Sequence
  Description of Artificial Sequence: Synthetic oligonucleotide
ccaaaccaccagccuccag

SEQ ID NO: 3059 - RNA, 19 nt, Artificial Sequence
  Description of Artificial Sequence: Synthetic oligonucleotide
gccaaaccaccagccucca

SEQ ID NO: 3060 - RNA, 19 nt, Artificial Sequence
  Description of Artificial Sequence: Synthetic oligonucleotide
ugccaaaccaccagccucc

SEQ ID NO: 3061 - RNA, 19 nt, Artificial Sequence
  Description of Artificial Sequence: Synthetic oligonucleotide
gugccaaaccaccagccuc

SEQ ID NO: 3062 - RNA, 19 nt, Artificial Sequence
  Description of Artificial Sequence: Synthetic oligonucleotide
ggugccaaaccaccagccu

SEQ ID NO: 3063 - RNA, 19 nt, Artificial Sequence
  Description of Artificial Sequence: Synthetic oligonucleotide
aggugccaaaccaccagcc

SEQ ID NO: 3064 - RNA, 19 nt, Artificial Sequence
  Description of Artificial Sequence: Synthetic oligonucleotide
caggugccaaaccaccagc

SEQ ID NO: 3065 - RNA, 19 nt, Artificial Sequence
  Description of Artificial Sequence: Synthetic oligonucleotide
gcaggugccaaaccaccag

SEQ ID NO: 3066 - RNA, 19 nt, Artificial Sequence
  Description of Artificial Sequence: Synthetic oligonucleotide
ugcaggugccaaaccacca

SEQ ID NO: 3067 - RNA, 19 nt, Artificial Sequence
  Description of Artificial Sequence: Synthetic oligonucleotide
cugcaggugccaaaccacc

SEQ ID NO: 3068 - RNA, 19 nt, Artificial Sequence
  Description of Artificial Sequence: Synthetic oligonucleotide
gcugcaggugccaaaccac

SEQ ID NO: 3069 - RNA, 19 nt, Artificial Sequence
  Description of Artificial Sequence: Synthetic oligonucleotide
ggcugcaggugccaaacca

SEQ ID NO: 3070 - RNA, 19 nt, Artificial Sequence
  Description of Artificial Sequence: Synthetic oligonucleotide
uggcugcaggugccaaacc

SEQ ID NO: 3071 - RNA, 19 nt, Artificial Sequence
  Description of Artificial Sequence: Synthetic oligonucleotide
auggcugcaggugccaaac

SEQ ID NO: 3072 - RNA, 19 nt, Artificial Sequence
  Description of Artificial Sequence: Synthetic oligonucleotide
aauggcugcaggugccaaa

SEQ ID NO: 3073 - RNA, 19 nt, Artificial Sequence
  Description of Artificial Sequence: Synthetic oligonucleotide
gaauggcugcaggugccaa

SEQ ID NO: 3074 - RNA, 19 nt, Artificial Sequence
  Description of Artificial Sequence: Synthetic oligonucleotide
ggaauggcugcaggugcca

SEQ ID NO: 3075 - RNA, 19 nt, Artificial Sequence
  Description of Artificial Sequence: Synthetic oligonucleotide
uggaauggcugcaggugcc

SEQ ID NO: 3076 - RNA, 19 nt, Artificial Sequence
  Description of Artificial Sequence: Synthetic oligonucleotide
uuggaauggcugcaggugc

SEQ ID NO: 3077 - RNA, 19 nt, Artificial Sequence
  Description of Artificial Sequence: Synthetic oligonucleotide
guuggaauggcugcaggug

SEQ ID NO: 3078 - RNA, 19 nt, Artificial Sequence
  Description of Artificial Sequence: Synthetic oligonucleotide
gguuggaauggcugcaggu

SEQ ID NO: 3079 - RNA, 19 nt, Artificial Sequence
  Description of Artificial Sequence: Synthetic oligonucleotide
agguuggaauggcugcagg

SEQ ID NO: 3080 - RNA, 19 nt, Artificial Sequence
  Description of Artificial Sequence: Synthetic oligonucleotide
gagguuggaauggcugcag

SEQ ID NO: 3081 - RNA, 19 nt, Artificial Sequence
  Description of Artificial Sequence: Synthetic oligonucleotide
ugagguuggaauggcugca

SEQ ID NO: 3082 - RNA, 19 nt, Artificial Sequence
  Description of Artificial Sequence: Synthetic oligonucleotide
uugagguuggaauggcugc

SEQ ID NO: 3083 - RNA, 19 nt, Artificial Sequence
  Description of Artificial Sequence: Synthetic oligonucleotide
guugagguuggaauggcug

SEQ ID NO: 3084 - RNA, 19 nt, Artificial Sequence
  Description of Artificial Sequence: Synthetic oligonucleotide
cguugagguuggaauggcu

SEQ ID NO: 3085 - RNA, 19 nt, Artificial Sequence
  Description of Artificial Sequence: Synthetic oligonucleotide
ccguugagguuggaauggc

SEQ ID NO: 3086 - RNA, 19 nt, Artificial Sequence
  Description of Artificial Sequence: Synthetic oligonucleotide
gccguugagguuggaaugg

SEQ ID NO: 3087 - RNA, 19 nt, Artificial Sequence
  Description of Artificial Sequence: Synthetic oligonucleotide
ggccguugagguuggaaug

SEQ ID NO: 3088 - RNA, 19 nt, Artificial Sequence
  Description of Artificial Sequence: Synthetic oligonucleotide
uggccguugagguuggaau

SEQ ID NO: 3089 - RNA, 19 nt, Artificial Sequence
  Description of Artificial Sequence: Synthetic oligonucleotide
cuggccguugagguuggaa

SEQ ID NO: 3090 - RNA, 19 nt, Artificial Sequence
  Description of Artificial Sequence: Synthetic oligonucleotide
acuggccguugagguugga

SEQ ID NO: 3091 - RNA, 19 nt, Artificial Sequence
  Description of Artificial Sequence: Synthetic oligonucleotide
uacuggccguugagguugg

SEQ ID NO: 3092 - RNA, 19 nt, Artificial Sequence
  Description of Artificial Sequence: Synthetic oligonucleotide
guacuggccguugagguug

SEQ ID NO: 3093 - RNA, 19 nt, Artificial Sequence
  Description of Artificial Sequence: Synthetic oligonucleotide
aguacuggccguugagguu

SEQ ID NO: 3094 - RNA, 19 nt, Artificial Sequence
  Description of Artificial Sequence: Synthetic oligonucleotide
aaguacuggccguugaggu

SEQ ID NO: 3095 - RNA, 19 nt, Artificial Sequence
  Description of Artificial Sequence: Synthetic oligonucleotide
gaaguacuggccguugagg

SEQ ID NO: 3096 - RNA, 19 nt, Artificial Sequence
  Description of Artificial Sequence: Synthetic oligonucleotide
ggaaguacuggccguugag

SEQ ID NO: 3097 - RNA, 19 nt, Artificial Sequence
  Description of Artificial Sequence: Synthetic oligonucleotide
cggaaguacuggccguuga

SEQ ID NO: 3098 - RNA, 19 nt, Artificial Sequence
  Description of Artificial Sequence: Synthetic oligonucleotide
gcggaaguacuggccguug

SEQ ID NO: 3099 - RNA, 19 nt, Artificial Sequence
  Description of Artificial Sequence: Synthetic oligonucleotide
agcggaaguacuggccguu

SEQ ID NO: 3100 - RNA, 19 nt, Artificial Sequence
  Description of Artificial Sequence: Synthetic oligonucleotide
gagcggaaguacuggccgu

SEQ ID NO: 3101 - RNA, 19 nt, Artificial Sequence
  Description of Artificial Sequence: Synthetic oligonucleotide
ggagcggaaguacuggccg

SEQ ID NO: 3102 - RNA, 19 nt, Artificial Sequence
  Description of Artificial Sequence: Synthetic oligonucleotide
uggagcggaaguacuggcc

SEQ ID NO: 3103 - RNA, 19 nt, Artificial Sequence
  Description of Artificial Sequence: Synthetic oligonucleotide
auggagcggaaguacuggc

SEQ ID NO: 3104 - RNA, 19 nt, Artificial Sequence
  Description of Artificial Sequence: Synthetic oligonucleotide
gauggagcggaaguacugg

SEQ ID NO: 3105 - RNA, 19 nt, Artificial Sequence
  Description of Artificial Sequence: Synthetic oligonucleotide
ggauggagcggaaguacug

SEQ ID NO: 3106 - RNA, 19 nt, Artificial Sequence
  Description of Artificial Sequence: Synthetic oligonucleotide
gggauggagcggaaguacu

SEQ ID NO: 3107 - RNA, 19 nt, Artificial Sequence
  Description of Artificial Sequence: Synthetic oligonucleotide
ugggauggagcggaaguac

SEQ ID NO: 3108 - RNA, 19 nt, Artificial Sequence
  Description of Artificial Sequence: Synthetic oligonucleotide
gugggauggagcggaagua

SEQ ID NO: 3109 - RNA, 19 nt, Artificial Sequence
  Description of Artificial Sequence: Synthetic oligonucleotide
ugugggauggagcggaagu

SEQ ID NO: 3110 - RNA, 19 nt, Artificial Sequence
  Description of Artificial Sequence: Synthetic oligonucleotide
cugugggauggagcggaag

SEQ ID NO: 3111 - RNA, 19 nt, Artificial Sequence
  Description of Artificial Sequence: Synthetic oligonucleotide
gcugugggauggagcggaa

SEQ ID NO: 3112 - RNA, 19 nt, Artificial Sequence
  Description of Artificial Sequence: Synthetic oligonucleotide
ugcugugggauggagcgga

SEQ ID NO: 3113 - RNA, 19 nt, Artificial Sequence
  Description of Artificial Sequence: Synthetic oligonucleotide
cugcugugggauggagcgg

SEQ ID NO: 3114 - RNA, 19 nt, Artificial Sequence
  Description of Artificial Sequence: Synthetic oligonucleotide
gcugcugugggauggagcg

SEQ ID NO: 3115 - RNA, 19 nt, Artificial Sequence
  Description of Artificial Sequence: Synthetic oligonucleotide
cgcugcugugggauggagc

SEQ ID NO: 3116 - RNA, 19 nt, Artificial Sequence
  Description of Artificial Sequence: Synthetic oligonucleotide
ccgcugcugugggauggag

SEQ ID NO: 3117 - RNA, 19 nt, Artificial Sequence
  Description of Artificial Sequence: Synthetic oligonucleotide
gccgcugcugugggaugga

SEQ ID NO: 3118 - RNA, 19 nt, Artificial Sequence
  Description of Artificial Sequence: Synthetic oligonucleotide
ugccgcugcugugggaugg

SEQ ID NO: 3119 - RNA, 19 nt, Artificial Sequence
  Description of Artificial Sequence: Synthetic oligonucleotide
cugccgcugcugugggaug

SEQ ID NO: 3120 - RNA, 19 nt, Artificial Sequence
  Description of Artificial Sequence: Synthetic oligonucleotide
ucugccgcugcugugggau

SEQ ID NO: 3121 - RNA, 19 nt, Artificial Sequence
  Description of Artificial Sequence: Synthetic oligonucleotide
uucugccgcugcuguggga

SEQ ID NO: 3122 - RNA, 19 nt, Artificial Sequence
  Description of Artificial Sequence: Synthetic oligonucleotide
cuucugccgcugcuguggg

SEQ ID NO: 3123 - RNA, 19 nt, Artificial Sequence
  Description of Artificial Sequence: Synthetic oligonucleotide
gcuucugccgcugcugugg

SEQ ID NO: 3124 - RNA, 19 nt, Artificial Sequence
  Description of Artificial Sequence: Synthetic oligonucleotide
agcuucugccgcugcugug

SEQ ID NO: 3125 - RNA, 19 nt, Artificial Sequence
  Description of Artificial Sequence: Synthetic oligonucleotide
aagcuucugccgcugcugu

SEQ ID NO: 3126 - RNA, 19 nt, Artificial Sequence
  Description of Artificial Sequence: Synthetic oligonucleotide
uaagcuucugccgcugcug

SEQ ID NO: 3127 - RNA, 19 nt, Artificial Sequence
  Description of Artificial Sequence: Synthetic oligonucleotide
uuaagcuucugccgcugcu

SEQ ID NO: 3128 - RNA, 19 nt, Artificial Sequence
  Description of Artificial Sequence: Synthetic oligonucleotide
cuuaagcuucugccgcugc

SEQ ID NO: 3129 - RNA, 19 nt, Artificial Sequence
  Description of Artificial Sequence: Synthetic oligonucleotide
ucuuaagcuucugccgcug

SEQ ID NO: 3130 - RNA, 19 nt, Artificial Sequence
  Description of Artificial Sequence: Synthetic oligonucleotide
uucuuaagcuucugccgcu

SEQ ID NO: 3131 - RNA, 19 nt, Artificial Sequence
  Description of Artificial Sequence: Synthetic oligonucleotide
cuucuuaagcuucugccgc

SEQ ID NO: 3132 - RNA, 19 nt, Artificial Sequence
  Description of Artificial Sequence: Synthetic oligonucleotide
ccuucuuaagcuucugccg

SEQ ID NO: 3133 - RNA, 19 nt, Artificial Sequence
  Description of Artificial Sequence: Synthetic oligonucleotide
cccuucuuaagcuucugcc

SEQ ID NO: 3134 - RNA, 19 nt, Artificial Sequence
  Description of Artificial Sequence: Synthetic oligonucleotide
ucccuucuuaagcuucugc

SEQ ID NO: 3135 - RNA, 19 nt, Artificial Sequence
  Description of Artificial Sequence: Synthetic oligonucleotide
uucccuucuuaagcuucug

SEQ ID NO: 3136 - RNA, 19 nt, Artificial Sequence
  Description of Artificial Sequence: Synthetic oligonucleotide
auucccuucuuaagcuucu

SEQ ID NO: 3137 - RNA, 19 nt, Artificial Sequence
  Description of Artificial Sequence: Synthetic oligonucleotide
gauucccuucuuaagcuuc

SEQ ID NO: 3138 - RNA, 19 nt, Artificial Sequence
  Description of Artificial Sequence: Synthetic oligonucleotide
agauucccuucuuaagcuu

SEQ ID NO: 3139 - RNA, 19 nt, Artificial Sequence
  Description of Artificial Sequence: Synthetic oligonucleotide
aagauucccuucuuaagcu

SEQ ID NO: 3140 - RNA, 19 nt, Artificial Sequence
  Description of Artificial Sequence: Synthetic oligonucleotide
gaagauucccuucuuaagc

SEQ ID NO: 3141 - RNA, 19 nt, Artificial Sequence
  Description of Artificial Sequence: Synthetic oligonucleotide
agaagauucccuucuuaag

SEQ ID NO: 3142 - RNA, 19 nt, Artificial Sequence
  Description of Artificial Sequence: Synthetic oligonucleotide
cagaagauucccuucuuaa

SEQ ID NO: 3143 - RNA, 19 nt, Artificial Sequence
  Description of Artificial Sequence: Synthetic oligonucleotide
ccagaagauucccuucuua

SEQ ID NO: 3144 - RNA, 19 nt, Artificial Sequence
  Description of Artificial Sequence: Synthetic oligonucleotide
uccagaagauucccuucuu

SEQ ID NO: 3145 - RNA, 19 nt, Artificial Sequence
  Description of Artificial Sequence: Synthetic oligonucleotide
uuccagaagauucccuucu

SEQ ID NO: 3146 - RNA, 19 nt, Artificial Sequence
  Description of Artificial Sequence: Synthetic oligonucleotide
cuuccagaagauucccuuc

SEQ ID NO: 3147 - RNA, 19 nt, Artificial Sequence
  Description of Artificial Sequence: Synthetic oligonucleotide
ucuuccagaagauucccuu

SEQ ID NO: 3148 - RNA, 19 nt, Artificial Sequence
  Description of Artificial Sequence: Synthetic oligonucleotide
gucuuccagaagauucccu

SEQ ID NO: 3149 - RNA, 19 nt, Artificial Sequence
  Description of Artificial Sequence: Synthetic oligonucleotide
ggucuuccagaagauuccc

SEQ ID NO: 3150 - RNA, 19 nt, Artificial Sequence
  Description of Artificial Sequence: Synthetic oligonucleotide
aggucuuccagaagauucc

SEQ ID NO: 3151 - RNA, 19 nt, Artificial Sequence
  Description of Artificial Sequence: Synthetic oligonucleotide
caggucuuccagaagauuc

SEQ ID NO: 3152 - RNA, 19 nt, Artificial Sequence
  Description of Artificial Sequence: Synthetic oligonucleotide
ccaggucuuccagaagauu

SEQ ID NO: 3153 - RNA, 19 nt, Artificial Sequence
  Description of Artificial Sequence: Synthetic oligonucleotide
gccaggucuuccagaagau

SEQ ID NO: 3154 - RNA, 19 nt, Artificial Sequence
  Description of Artificial Sequence: Synthetic oligonucleotide
cgccaggucuuccagaaga

SEQ ID NO: 3155 - RNA, 19 nt, Artificial Sequence
  Description of Artificial Sequence: Synthetic oligonucleotide
ccgccaggucuuccagaag

SEQ ID NO: 3156 - RNA, 19 nt, Artificial Sequence
  Description of Artificial Sequence: Synthetic oligonucleotide
cccgccaggucuuccagaa

SEQ ID NO: 3157 - RNA, 19 nt, Artificial Sequence
  Description of Artificial Sequence: Synthetic oligonucleotide
ccccgccaggucuuccaga

SEQ ID NO: 3158 - RNA, 19 nt, Artificial Sequence
  Description of Artificial Sequence: Synthetic oligonucleotide
gccccgccaggucuuccag

SEQ ID NO: 3159 - RNA, 19 nt, Artificial Sequence
  Description of Artificial Sequence: Synthetic oligonucleotide
ggccccgccaggucuucca

SEQ ID NO: 3160 - RNA, 19 nt, Artificial Sequence
  Description of Artificial Sequence: Synthetic oligonucleotide
cggccccgccaggucuucc

SEQ ID NO: 3161 - RNA, 19 nt, Artificial Sequence
  Description of Artificial Sequence: Synthetic oligonucleotide
gcggccccgccaggucuuc

SEQ ID NO: 3162 - RNA, 19 nt, Artificial Sequence
  Description of Artificial Sequence: Synthetic oligonucleotide
agcggccccgccaggucuu

SEQ ID NO: 3163 - RNA, 19 nt, Artificial Sequence
  Description of Artificial Sequence: Synthetic oligonucleotide
uagcggccccgccaggucu

SEQ ID NO: 3164 - RNA, 19 nt, Artificial Sequence
  Description of Artificial Sequence: Synthetic oligonucleotide
guagcggccccgccagguc

SEQ ID NO: 3165 - RNA, 19 nt, Artificial Sequence
  Description of Artificial Sequence: Synthetic oligonucleotide
aguagcggccccgccaggu

SEQ ID NO: 3166 - RNA, 19 nt, Artificial Sequence
  Description of Artificial Sequence: Synthetic oligonucleotide
uaguagcggccccgccagg

SEQ ID NO: 3167 - RNA, 19 nt, Artificial Sequence
  Description of Artificial Sequence: Synthetic oligonucleotide
guaguagcggccccgccag

SEQ ID NO: 3168 - RNA, 19 nt, Artificial Sequence
  Description of Artificial Sequence: Synthetic oligonucleotide
gguaguagcggccccgcca

SEQ ID NO: 3169 - RNA, 19 nt, Artificial Sequence
  Description of Artificial Sequence: Synthetic oligonucleotide
ggguaguagcggccccgcc

SEQ ID NO: 3170 - RNA, 19 nt, Artificial Sequence
  Description of Artificial Sequence: Synthetic oligonucleotide
cggguaguagcggccccgc

SEQ ID NO: 3171 - RNA, 19 nt, Artificial Sequence
  Description of Artificial Sequence: Synthetic oligonucleotide
gcggguaguagcggccccg

SEQ ID NO: 3172 - RNA, 19 nt, Artificial Sequence
  Description of Artificial Sequence: Synthetic oligonucleotide
agcggguaguagcggcccc

SEQ ID NO: 3173 - RNA, 19 nt, Artificial Sequence
  Description of Artificial Sequence: Synthetic oligonucleotide
cagcggguaguagcggccc

SEQ ID NO: 3174 - RNA, 19 nt, Artificial Sequence
  Description of Artificial Sequence: Synthetic oligonucleotide
gcagcggguaguagcggcc

SEQ ID NO: 3175 - RNA, 19 nt, Artificial Sequence
  Description of Artificial Sequence: Synthetic oligonucleotide
ugcagcggguaguagcggc

SEQ ID NO: 3176 - RNA, 19 nt, Artificial Sequence
  Description of Artificial Sequence: Synthetic oligonucleotide
cugcagcggguaguagcgg

SEQ ID NO: 3177 - RNA, 19 nt, Artificial Sequence
  Description of Artificial Sequence: Synthetic oligonucleotide
ccugcagcggguaguagcg

SEQ ID NO: 3178 - RNA, 19 nt, Artificial Sequence
  Description of Artificial Sequence: Synthetic oligonucleotide
gccugcagcggguaguagc

SEQ ID NO: 3179 - RNA, 19 nt, Artificial Sequence
  Description of Artificial Sequence: Synthetic oligonucleotide
ggccugcagcggguaguag

SEQ ID NO: 3180 - RNA, 19 nt, Artificial Sequence
  Description of Artificial Sequence: Synthetic oligonucleotide
uggccugcagcggguagua

SEQ ID NO: 3181 - RNA, 19 nt, Artificial Sequence
  Description of Artificial Sequence: Synthetic oligonucleotide
guggccugcagcggguagu

SEQ ID NO: 3182 - RNA, 19 nt, Artificial Sequence
  Description of Artificial Sequence: Synthetic oligonucleotide
gguggccugcagcggguag

SEQ ID NO: 3183 - RNA, 19 nt, Artificial Sequence
  Description of Artificial Sequence: Synthetic oligonucleotide
ugguggccugcagcgggua

SEQ ID NO: 3184 - RNA, 19 nt, Artificial Sequence
  Description of Artificial Sequence: Synthetic oligonucleotide
gugguggccugcagcgggu

SEQ ID NO: 3185 - RNA, 19 nt, Artificial Sequence
  Description of Artificial Sequence: Synthetic oligonucleotide
ggugguggccugcagcggg

SEQ ID NO: 3186 - RNA, 19 nt, Artificial Sequence
  Description of Artificial Sequence: Synthetic oligonucleotide
uggugguggccugcagcgg

SEQ ID NO: 3187 - RNA, 19 nt, Artificial Sequence
  Description of Artificial Sequence: Synthetic oligonucleotide
auggugguggccugcagcg

SEQ ID NO: 3188 - RNA, 19 nt, Artificial Sequence
  Description of Artificial Sequence: Synthetic oligonucleotide
cauggugguggccugcagc

SEQ ID NO: 3189 - RNA, 19 nt, Artificial Sequence
  Description of Artificial Sequence: Synthetic oligonucleotide
acauggugguggccugcag

SEQ ID NO: 3190 - RNA, 19 nt, Artificial Sequence
  Description of Artificial Sequence: Synthetic oligonucleotide
aacauggugguggccugca

SEQ ID NO: 3191 - RNA, 19 nt, Artificial Sequence
  Description of Artificial Sequence: Synthetic oligonucleotide
caacauggugguggccugc

SEQ ID NO: 3192 - RNA, 19 nt, Artificial Sequence
  Description of Artificial Sequence: Synthetic oligonucleotide
ucaacauggugguggccug

SEQ ID NO: 3193 - RNA, 19 nt, Artificial Sequence
  Description of Artificial Sequence: Synthetic oligonucleotide
aucaacauggugguggccu

SEQ ID NO: 3194 - RNA, 19 nt, Artificial Sequence
  Description of Artificial Sequence: Synthetic oligonucleotide
gaucaacauggugguggcc

SEQ ID NO: 3195 - RNA, 19 nt, Artificial Sequence
  Description of Artificial Sequence: Synthetic oligonucleotide
ggaucaacauggugguggc

SEQ ID NO: 3196 - RNA, 19 nt, Artificial Sequence
  Description of Artificial Sequence: Synthetic oligonucleotide
uggaucaacaugguggugg

SEQ ID NO: 3197 - RNA, 19 nt, Artificial Sequence
  Description of Artificial Sequence: Synthetic oligonucleotide
cuggaucaacaugguggug

SEQ ID NO: 3198 - RNA, 19 nt, Artificial Sequence
  Description of Artificial Sequence: Synthetic oligonucleotide
gcuggaucaacaugguggu

SEQ ID NO: 3199 - RNA, 19 nt, Artificial Sequence
  Description of Artificial Sequence: Synthetic oligonucleotide
ggcuggaucaacauggugg

SEQ ID NO: 3200 - RNA, 19 nt, Artificial Sequence
  Description of Artificial Sequence: Synthetic oligonucleotide
gggcuggaucaacauggug

SEQ ID NO: 3201 - RNA, 19 nt, Artificial Sequence
  Description of Artificial Sequence: Synthetic oligonucleotide
ugggcuggaucaacauggu

SEQ ID NO: 3202 - RNA, 19 nt, Artificial Sequence
  Description of Artificial Sequence: Synthetic oligonucleotide
augggcuggaucaacaugg

SEQ ID NO: 3203 - RNA, 19 nt, Artificial Sequence
  Description of Artificial Sequence: Synthetic oligonucleotide
caugggcuggaucaacaug

SEQ ID NO: 3204 - RNA, 19 nt, Artificial Sequence
  Description of Artificial Sequence: Synthetic oligonucleotide
ccaugggcuggaucaacau

SEQ ID NO: 3205 - RNA, 19 nt, Artificial Sequence
  Description of Artificial Sequence: Synthetic oligonucleotide
gccaugggcuggaucaaca

SEQ ID NO: 3206 - RNA, 19 nt, Artificial Sequence
  Description of Artificial Sequence: Synthetic oligonucleotide
ugccaugggcuggaucaac

SEQ ID NO: 3207 - RNA, 19 nt, Artificial Sequence
  Description of Artificial Sequence: Synthetic oligonucleotide
cugccaugggcuggaucaa

SEQ ID NO: 3208 - RNA, 19 nt, Artificial Sequence
  Description of Artificial Sequence: Synthetic oligonucleotide
gcugccaugggcuggauca

SEQ ID NO: 3209 - RNA, 19 nt, Artificial Sequence
  Description of Artificial Sequence: Synthetic oligonucleotide
ugcugccaugggcuggauc

SEQ ID NO: 3210 - RNA, 19 nt, Artificial Sequence
  Description of Artificial Sequence: Synthetic oligonucleotide
cugcugccaugggcuggau

SEQ ID NO: 3211 - RNA, 19 nt, Artificial Sequence
  Description of Artificial Sequence: Synthetic oligonucleotide
ucugcugccaugggcugga

SEQ ID NO: 3212 - RNA, 19 nt, Artificial Sequence
  Description of Artificial Sequence: Synthetic oligonucleotide
cucugcugccaugggcugg

SEQ ID NO: 3213 - RNA, 19 nt, Artificial Sequence
  Description of Artificial Sequence: Synthetic oligonucleotide
ccucugcugccaugggcug

SEQ ID NO: 3214 - RNA, 19 nt, Artificial Sequence
  Description of Artificial Sequence: Synthetic oligonucleotide
gccucugcugccaugggcu

SEQ ID NO: 3215 - RNA, 19 nt, Artificial Sequence
  Description of Artificial Sequence: Synthetic oligonucleotide
ugccucugcugccaugggc

SEQ ID NO: 3216 - RNA, 19 nt, Artificial Sequence
  Description of Artificial Sequence: Synthetic oligonucleotide
cugccucugcugccauggg

SEQ ID NO: 3217 - RNA, 19 nt, Artificial Sequence
  Description of Artificial Sequence: Synthetic oligonucleotide
gcugccucugcugccaugg

SEQ ID NO: 3218 - RNA, 19 nt, Artificial Sequence
  Description of Artificial Sequence: Synthetic oligonucleotide
ggcugccucugcugccaug

SEQ ID NO: 3219 - RNA, 19 nt, Artificial Sequence
  Description of Artificial Sequence: Synthetic oligonucleotide
aggcugccucugcugccau

SEQ ID NO: 3220 - RNA, 19 nt, Artificial Sequence
  Description of Artificial Sequence: Synthetic oligonucleotide
gaggcugccucugcugcca

SEQ ID NO: 3221 - RNA, 19 nt, Artificial Sequence
  Description of Artificial Sequence: Synthetic oligonucleotide
ggaggcugccucugcugcc

SEQ ID NO: 3222 - RNA, 19 nt, Artificial Sequence
  Description of Artificial Sequence: Synthetic oligonucleotide
aggaggcugccucugcugc

SEQ ID NO: 3223 - RNA, 19 nt, Artificial Sequence
  Description of Artificial Sequence: Synthetic oligonucleotide
uaggaggcugccucugcug

SEQ ID NO: 3224 - RNA, 19 nt, Artificial Sequence
  Description of Artificial Sequence: Synthetic oligonucleotide
cuaggaggcugccucugcu

SEQ ID NO: 3225 - RNA, 19 nt, Artificial Sequence
  Description of Artificial Sequence: Synthetic oligonucleotide
gcuaggaggcugccucugc

SEQ ID NO: 3226 - RNA, 19 nt, Artificial Sequence
  Description of Artificial Sequence: Synthetic oligonucleotide
cgcuaggaggcugccucug

SEQ ID NO: 3227 - RNA, 19 nt, Artificial Sequence
  Description of Artificial Sequence: Synthetic oligonucleotide
acgcuaggaggcugccucu

SEQ ID NO: 3228 - RNA, 19 nt, Artificial Sequence
  Description of Artificial Sequence: Synthetic oligonucleotide
gacgcuaggaggcugccuc

SEQ ID NO: 3229 - RNA, 19 nt, Artificial Sequence
  Description of Artificial Sequence: Synthetic oligonucleotide
ggacgcuaggaggcugccu

SEQ ID NO: 3230 - RNA, 19 nt, Artificial Sequence
  Description of Artificial Sequence: Synthetic oligonucleotide
aggacgcuaggaggcugcc

SEQ ID NO: 3231 - RNA, 19 nt, Artificial Sequence
  Description of Artificial Sequence: Synthetic oligonucleotide
caggacgcuaggaggcugc

SEQ ID NO: 3232 - RNA, 19 nt, Artificial Sequence
  Description of Artificial Sequence: Synthetic oligonucleotide
ccaggacgcuaggaggcug

SEQ ID NO: 3233 - RNA, 19 nt, Artificial Sequence
  Description of Artificial Sequence: Synthetic oligonucleotide
gccaggacgcuaggaggcu

SEQ ID NO: 3234 - RNA, 19 nt, Artificial Sequence
  Description of Artificial Sequence: Synthetic oligonucleotide
agccaggacgcuaggaggc

SEQ ID NO: 3235 - RNA, 19 nt, Artificial Sequence
  Description of Artificial Sequence: Synthetic oligonucleotide
cagccaggacgcuaggagg

SEQ ID NO: 3236 - RNA, 19 nt, Artificial Sequence
  Description of Artificial Sequence: Synthetic oligonucleotide
ccagccaggacgcuaggag

SEQ ID NO: 3237 - RNA, 19 nt, Artificial Sequence
  Description of Artificial Sequence: Synthetic oligonucleotide
cccagccaggacgcuagga

SEQ ID NO: 3238 - RNA, 19 nt, Artificial Sequence
  Description of Artificial Sequence: Synthetic oligonucleotide
gcccagccaggacgcuagg

SEQ ID NO: 3239 - RNA, 19 nt, Artificial Sequence
  Description of Artificial Sequence: Synthetic oligonucleotide
ggcccagccaggacgcuag

SEQ ID NO: 3240 - RNA, 19 nt, Artificial Sequence
  Description of Artificial Sequence: Synthetic oligonucleotide
aggcccagccaggacgcua

SEQ ID NO: 3241 - RNA, 19 nt, Artificial Sequence
  Description of Artificial Sequence: Synthetic oligonucleotide
caggcccagccaggacgcu

SEQ ID NO: 3242 - RNA, 19 nt, Artificial Sequence
  Description of Artificial Sequence: Synthetic oligonucleotide
ccaggcccagccaggacgc

SEQ ID NO: 3243 - RNA, 19 nt, Artificial Sequence
  Description of Artificial Sequence: Synthetic oligonucleotide
accaggcccagccaggacg

SEQ ID NO: 3244 - RNA, 19 nt, Artificial Sequence
  Description of Artificial Sequence: Synthetic oligonucleotide
gaccaggcccagccaggac

SEQ ID NO: 3245 - RNA, 19 nt, Artificial Sequence
  Description of Artificial Sequence: Synthetic oligonucleotide
ggaccaggcccagccagga

SEQ ID NO: 3246 - RNA, 19 nt, Artificial Sequence
  Description of Artificial Sequence: Synthetic oligonucleotide
gggaccaggcccagccagg

SEQ ID NO: 3247 - RNA, 19 nt, Artificial Sequence
  Description of Artificial Sequence: Synthetic oligonucleotide
ugggaccaggcccagccag

SEQ ID NO: 3248 - RNA, 19 nt, Artificial Sequence
  Description of Artificial Sequence: Synthetic oligonucleotide
cugggaccaggcccagcca

SEQ ID NO: 3249 - RNA, 19 nt, Artificial Sequence
  Description of Artificial Sequence: Synthetic oligonucleotide
ccugggaccaggcccagcc

SEQ ID NO: 3250 - RNA, 19 nt, Artificial Sequence
  Description of Artificial Sequence: Synthetic oligonucleotide
gccugggaccaggcccagc

SEQ ID NO: 3251 - RNA, 19 nt, Artificial Sequence
  Description of Artificial Sequence: Synthetic oligonucleotide
ggccugggaccaggcccag

SEQ ID NO: 3252 - RNA, 19 nt, Artificial Sequence
  Description of Artificial Sequence: Synthetic oligonucleotide
gggccugggaccaggccca

SEQ ID NO: 3253 - RNA, 19 nt, Artificial Sequence
  Description of Artificial Sequence: Synthetic oligonucleotide
ugggccugggaccaggccc

SEQ ID NO: 3254 - RNA, 19 nt, Artificial Sequence
  Description of Artificial Sequence: Synthetic oligonucleotide
gugggccugggaccaggcc

SEQ ID NO: 3255 - RNA, 19 nt, Artificial Sequence
  Description of Artificial Sequence: Synthetic oligonucleotide
cgugggccugggaccaggc

SEQ ID NO: 3256 - RNA, 19 nt, Artificial Sequence
  Description of Artificial Sequence: Synthetic oligonucleotide
ucgugggccugggaccagg

SEQ ID NO: 3257 - RNA, 19 nt, Artificial Sequence
  Description of Artificial Sequence: Synthetic oligonucleotide
uucgugggccugggaccag

SEQ ID NO: 3258 - RNA, 19 nt, Artificial Sequence
  Description of Artificial Sequence: Synthetic oligonucleotide
uuucgugggccugggacca

SEQ ID NO: 3259 - RNA, 19 nt, Artificial Sequence
  Description of Artificial Sequence: Synthetic oligonucleotide
cuuucgugggccugggacc

SEQ ID NO: 3260 - RNA, 19 nt, Artificial Sequence
  Description of Artificial Sequence: Synthetic oligonucleotide
ucuuucgugggccugggac

SEQ ID NO: 3261 - RNA, 19 nt, Artificial Sequence
  Description of Artificial Sequence: Synthetic oligonucleotide
gucuuucgugggccuggga

SEQ ID NO: 3262 - RNA, 19 nt, Artificial Sequence
  Description of Artificial Sequence: Synthetic oligonucleotide
cgucuuucgugggccuggg

SEQ ID NO: 3263 - RNA, 19 nt, Artificial Sequence
  Description of Artificial Sequence: Synthetic oligonucleotide
ccgucuuucgugggccugg

SEQ ID NO: 3264 - RNA, 19 nt, Artificial Sequence
  Description of Artificial Sequence: Synthetic oligonucleotide
accgucuuucgugggccug

SEQ ID NO: 3265 - RNA, 19 nt, Artificial Sequence
  Description of Artificial Sequence: Synthetic oligonucleotide
caccgucuuucgugggccu

SEQ ID NO: 3266 - RNA, 19 nt, Artificial Sequence
  Description of Artificial Sequence: Synthetic oligonucleotide
ucaccgucuuucgugggcc

SEQ ID NO: 3267 - RNA, 19 nt, Artificial Sequence
  Description of Artificial Sequence: Synthetic oligonucleotide
gucaccgucuuucgugggc

SEQ ID NO: 3268 - RNA, 19 nt, Artificial Sequence
  Description of Artificial Sequence: Synthetic oligonucleotide
agucaccgucuuucguggg

SEQ ID NO: 3269 - RNA, 19 nt, Artificial Sequence
  Description of Artificial Sequence: Synthetic oligonucleotide
gagucaccgucuuucgugg

SEQ ID NO: 3270 - RNA, 19 nt, Artificial Sequence
  Description of Artificial Sequence: Synthetic oligonucleotide
agagucaccgucuuucgug

SEQ ID NO: 3271 - RNA, 19 nt, Artificial Sequence
  Description of Artificial Sequence: Synthetic oligonucleotide
aagagucaccgucuuucgu

SEQ ID NO: 3272 - RNA, 19 nt, Artificial Sequence
  Description of Artificial Sequence: Synthetic oligonucleotide
caagagucaccgucuuucg

SEQ ID NO: 3273 - RNA, 19 nt, Artificial Sequence
  Description of Artificial Sequence: Synthetic oligonucleotide
ccaagagucaccgucuuuc

SEQ ID NO: 3274 - RNA, 19 nt, Artificial Sequence
  Description of Artificial Sequence: Synthetic oligonucleotide
gccaagagucaccgucuuu

SEQ ID NO: 3275 - RNA, 19 nt, Artificial Sequence
  Description of Artificial Sequence: Synthetic oligonucleotide
agccaagagucaccgucuu

SEQ ID NO: 3276 - RNA, 19 nt, Artificial Sequence
  Description of Artificial Sequence: Synthetic oligonucleotide
gagccaagagucaccgucu

SEQ ID NO: 3277 - RNA, 19 nt, Artificial Sequence
  Description of Artificial Sequence: Synthetic oligonucleotide
agagccaagagucaccguc

SEQ ID NO: 3278 - RNA, 19 nt, Artificial Sequence
  Description of Artificial Sequence: Synthetic oligonucleotide
cagagccaagagucaccgu

SEQ ID NO: 3279 - RNA, 19 nt, Artificial Sequence
  Description of Artificial Sequence: Synthetic oligonucleotide
gcagagccaagagucaccg

SEQ ID NO: 3280 - RNA, 19 nt, Artificial Sequence
  Description of Artificial Sequence: Synthetic oligonucleotide
ggcagagccaagagucacc

SEQ ID NO: 3281 - RNA, 19 nt, Artificial Sequence
  Description of Artificial Sequence: Synthetic oligonucleotide
gggcagagccaagagucac

SEQ ID NO: 3282 - RNA, 19 nt, Artificial Sequence
  Description of Artificial Sequence: Synthetic oligonucleotide
cgggcagagccaagaguca

SEQ ID NO: 3283 - RNA, 19 nt, Artificial Sequence
  Description of Artificial Sequence: Synthetic oligonucleotide
ucgggcagagccaagaguc

SEQ ID NO: 3284 - RNA, 19 nt, Artificial Sequence
  Description of Artificial Sequence: Synthetic oligonucleotide
cucgggcagagccaagagu

SEQ ID NO: 3285 - RNA, 19 nt, Artificial Sequence
  Description of Artificial Sequence: Synthetic oligonucleotide
ccucgggcagagccaagag

SEQ ID NO: 3286 - RNA, 19 nt, Artificial Sequence
  Description of Artificial Sequence: Synthetic oligonucleotide
uccucgggcagagccaaga

SEQ ID NO: 3287 - RNA, 19 nt, Artificial Sequence
  Description of Artificial Sequence: Synthetic oligonucleotide
auccucgggcagagccaag

SEQ ID NO: 3288 - RNA, 19 nt, Artificial Sequence
  Description of Artificial Sequence: Synthetic oligonucleotide
cauccucgggcagagccaa

SEQ ID NO: 3289 - RNA, 19 nt, Artificial Sequence
  Description of Artificial Sequence: Synthetic oligonucleotide
acauccucgggcagagcca

SEQ ID NO: 3290 - RNA, 19 nt, Artificial Sequence
  Description of Artificial Sequence: Synthetic oligonucleotide
cacauccucgggcagagcc

SEQ ID NO: 3291 - RNA, 19 nt, Artificial Sequence
  Description of Artificial Sequence: Synthetic oligonucleotide
ccacauccucgggcagagc

SEQ ID NO: 3292 - RNA, 19 nt, Artificial Sequence
  Description of Artificial Sequence: Synthetic oligonucleotide
gccacauccucgggcagag

SEQ ID NO: 3293 - RNA, 19 nt, Artificial Sequence
  Description of Artificial Sequence: Synthetic oligonucleotide
ggccacauccucgggcaga

SEQ ID NO: 3294 - RNA, 19 nt, Artificial Sequence
  Description of Artificial Sequence: Synthetic oligonucleotide
cggccacauccucgggcag

SEQ ID NO: 3295 - RNA, 19 nt, Artificial Sequence
  Description of Artificial Sequence: Synthetic oligonucleotide
acggccacauccucgggca

SEQ ID NO: 3296 - RNA, 19 nt, Artificial Sequence
  Description of Artificial Sequence: Synthetic oligonucleotide
aacggccacauccucgggc

SEQ ID NO: 3297 - RNA, 19 nt, Artificial Sequence
  Description of Artificial Sequence: Synthetic oligonucleotide
gaacggccacauccucggg

SEQ ID NO: 3298 - RNA, 19 nt, Artificial Sequence
  Description of Artificial Sequence: Synthetic oligonucleotide
ggaacggccacauccucgg

SEQ ID NO: 3299 - RNA, 19 nt, Artificial Sequence
  Description of Artificial Sequence: Synthetic oligonucleotide
gggaacggccacauccucg

SEQ ID NO: 3300 - RNA, 19 nt, Artificial Sequence
  Description of Artificial Sequence: Synthetic oligonucleotide
agggaacggccacauccuc

SEQ ID NO: 3301 - RNA, 19 nt, Artificial Sequence
  Description of Artificial Sequence: Synthetic oligonucleotide
cagggaacggccacauccu

SEQ ID NO: 3302 - RNA, 19 nt, Artificial Sequence
  Description of Artificial Sequence: Synthetic oligonucleotide
gcagggaacggccacaucc

SEQ ID NO: 3303 - RNA, 19 nt, Artificial Sequence
  Description of Artificial Sequence: Synthetic oligonucleotide
ggcagggaacggccacauc

SEQ ID NO: 3304 - RNA, 19 nt, Artificial Sequence
  Description of Artificial Sequence: Synthetic oligonucleotide
aggcagggaacggccacau

SEQ ID NO: 3305 - RNA, 19 nt, Artificial Sequence
  Description of Artificial Sequence: Synthetic oligonucleotide
caggcagggaacggccaca

SEQ ID NO: 3306 - RNA, 19 nt, Artificial Sequence
  Description of Artificial Sequence: Synthetic oligonucleotide
ccaggcagggaacggccac

SEQ ID NO: 3307 - RNA, 19 nt, Artificial Sequence
  Description of Artificial Sequence: Synthetic oligonucleotide
cccaggcagggaacggcca

SEQ ID NO: 3308 - RNA, 19 nt, Artificial Sequence
  Description of Artificial Sequence: Synthetic oligonucleotide
gcccaggcagggaacggcc

SEQ ID NO: 3309 - RNA, 19 nt, Artificial Sequence
  Description of Artificial Sequence: Synthetic oligonucleotide
ugcccaggcagggaacggc

SEQ ID NO: 3310 - RNA, 19 nt, Artificial Sequence
  Description of Artificial Sequence: Synthetic oligonucleotide
cugcccaggcagggaacgg

SEQ ID NO: 3311 - RNA, 19 nt, Artificial Sequence
  Description of Artificial Sequence: Synthetic oligonucleotide
ccugcccaggcagggaacg

SEQ ID NO: 3312 - RNA, 19 nt, Artificial Sequence
  Description of Artificial Sequence: Synthetic oligonucleotide
cccugcccaggcagggaac

SEQ ID NO: 3313 - RNA, 19 nt, Artificial Sequence
  Description of Artificial Sequence: Synthetic oligonucleotide
ccccugcccaggcagggaa

SEQ ID NO: 3314 - RNA, 19 nt, Artificial Sequence
  Description of Artificial Sequence: Synthetic oligonucleotide
gccccugcccaggcaggga

SEQ ID NO: 3315 - RNA, 19 nt, Artificial Sequence
  Description of Artificial Sequence: Synthetic oligonucleotide
agccccugcccaggcaggg

SEQ ID NO: 3316 - RNA, 19 nt, Artificial Sequence
  Description of Artificial Sequence: Synthetic oligonucleotide
gagccccugcccaggcagg

SEQ ID NO: 3317 - RNA, 19 nt, Artificial Sequence
  Description of Artificial Sequence: Synthetic oligonucleotide
ggagccccugcccaggcag

SEQ ID NO: 3318 - RNA, 19 nt, Artificial Sequence
  Description of Artificial Sequence: Synthetic oligonucleotide
uggagccccugcccaggca

SEQ ID NO: 3319 - RNA, 19 nt, Artificial Sequence
  Description of Artificial Sequence: Synthetic oligonucleotide
uuggagccccugcccaggc

SEQ ID NO: 3320 - RNA, 19 nt, Artificial Sequence
  Description of Artificial Sequence: Synthetic oligonucleotide
cuuggagccccugcccagg

SEQ ID NO: 3321 - RNA, 19 nt, Artificial Sequence
  Description of Artificial Sequence: Synthetic oligonucleotide
ccuuggagccccugcccag

SEQ ID NO: 3322 - RNA, 19 nt, Artificial Sequence
  Description of Artificial Sequence: Synthetic oligonucleotide
uccuuggagccccugccca

SEQ ID NO: 3323 - RNA, 19 nt, Artificial Sequence
  Description of Artificial Sequence: Synthetic oligonucleotide
cuccuuggagccccugccc

SEQ ID NO: 3324 - RNA, 19 nt, Artificial Sequence
  Description of Artificial Sequence: Synthetic oligonucleotide
ccuccuuggagccccugcc

SEQ ID NO: 3325 - RNA, 19 nt, Artificial Sequence
  Description of Artificial Sequence: Synthetic oligonucleotide
cccuccuuggagccccugc

SEQ ID NO: 3326 - RNA, 19 nt, Artificial Sequence
  Description of Artificial Sequence: Synthetic oligonucleotide
ccccuccuuggagccccug

SEQ ID NO: 3327 - RNA, 19 nt, Artificial Sequence
  Description of Artificial Sequence: Synthetic oligonucleotide
gccccuccuuggagccccu

SEQ ID NO: 3328 - RNA, 19 nt, Artificial Sequence
  Description of Artificial Sequence: Synthetic oligonucleotide
ggccccuccuuggagcccc

SEQ ID NO: 3329 - RNA, 19 nt, Artificial Sequence
  Description of Artificial Sequence: Synthetic oligonucleotide
uggccccuccuuggagccc

SEQ ID NO: 3330 - RNA, 19 nt, Artificial Sequence
  Description of Artificial Sequence: Synthetic oligonucleotide
auggccccuccuuggagcc

SEQ ID NO: 3331 - RNA, 19 nt, Artificial Sequence
  Description of Artificial Sequence: Synthetic oligonucleotide
gauggccccuccuuggagc

SEQ ID NO: 3332 - RNA, 19 nt, Artificial Sequence
  Description of Artificial Sequence: Synthetic oligonucleotide
agauggccccuccuuggag

SEQ ID NO: 3333 - RNA, 19 nt, Artificial Sequence
  Description of Artificial Sequence: Synthetic oligonucleotide
cagauggccccuccuugga

SEQ ID NO: 3334 - RNA, 19 nt, Artificial Sequence
  Description of Artificial Sequence: Synthetic oligonucleotide
ccagauggccccuccuugg

SEQ ID NO: 3335 - RNA, 19 nt, Artificial Sequence
  Description of Artificial Sequence: Synthetic oligonucleotide
uccagauggccccuccuug

SEQ ID NO: 3336 - RNA, 19 nt, Artificial Sequence
  Description of Artificial Sequence: Synthetic oligonucleotide
uuccagauggccccuccuu

SEQ ID NO: 3337 - RNA, 19 nt, Artificial Sequence
  Description of Artificial Sequence: Synthetic oligonucleotide
uuuccagauggccccuccu

SEQ ID NO: 3338 - RNA, 19 nt, Artificial Sequence
  Description of Artificial Sequence: Synthetic oligonucleotide
guuuccagauggccccucc

SEQ ID NO: 3339 - RNA, 19 nt, Artificial Sequence
  Description of Artificial Sequence: Synthetic oligonucleotide
aguuuccagauggccccuc

SEQ ID NO: 3340 - RNA, 19 nt, Artificial Sequence
  Description of Artificial Sequence: Synthetic oligonucleotide
aaguuuccagauggccccu

SEQ ID NO: 3341 - RNA, 19 nt, Artificial Sequence
  Description of Artificial Sequence: Synthetic oligonucleotide
caaguuuccagauggcccc

SEQ ID NO: 3342 - RNA, 19 nt, Artificial Sequence
  Description of Artificial Sequence: Synthetic oligonucleotide
acaaguuuccagauggccc

SEQ ID NO: 3343 - RNA, 19 nt, Artificial Sequence
  Description of Artificial Sequence: Synthetic oligonucleotide
cacaaguuuccagauggcc

SEQ ID NO: 3344 - RNA, 19 nt, Artificial Sequence
  Description of Artificial Sequence: Synthetic oligonucleotide
ccacaaguuuccagauggc

SEQ ID NO: 3345 - RNA, 19 nt, Artificial Sequence
  Description of Artificial Sequence: Synthetic oligonucleotide
uccacaaguuuccagaugg

SEQ ID NO: 3346 - RNA, 19 nt, Artificial Sequence
  Description of Artificial Sequence: Synthetic oligonucleotide
guccacaaguuuccagaug

SEQ ID NO: 3347 - RNA, 19 nt, Artificial Sequence
  Description of Artificial Sequence: Synthetic oligonucleotide
uguccacaaguuuccagau

SEQ ID NO: 3348 - RNA, 19 nt, Artificial Sequence
  Description of Artificial Sequence: Synthetic oligonucleotide
cuguccacaaguuuccaga

SEQ ID NO: 3349 - RNA, 19 nt, Artificial Sequence
  Description of Artificial Sequence: Synthetic oligonucleotide
ucuguccacaaguuuccag

SEQ ID NO: 3350 - RNA, 19 nt, Artificial Sequence
  Description of Artificial Sequence: Synthetic oligonucleotide
cucuguccacaaguuucca

SEQ ID NO: 3351 - RNA, 19 nt, Artificial Sequence
  Description of Artificial Sequence: Synthetic oligonucleotide
ucucuguccacaaguuucc

SEQ ID NO: 3352 - RNA, 19 nt, Artificial Sequence
  Description of Artificial Sequence: Synthetic oligonucleotide
uucucuguccacaaguuuc

SEQ ID NO: 3353 - RNA, 19 nt, Artificial Sequence
  Description of Artificial Sequence: Synthetic oligonucleotide
cuucucuguccacaaguuu

SEQ ID NO: 3354 - RNA, 19 nt, Artificial Sequence
  Description of Artificial Sequence: Synthetic oligonucleotide
ucuucucuguccacaaguu

SEQ ID NO: 3355 - RNA, 19 nt, Artificial Sequence
  Description of Artificial Sequence: Synthetic oligonucleotide
uucuucucuguccacaagu

SEQ ID NO: 3356 - RNA, 19 nt, Artificial Sequence
  Description of Artificial Sequence: Synthetic oligonucleotide
cuucuucucuguccacaag

SEQ ID NO: 3357 - RNA, 19 nt, Artificial Sequence
  Description of Artificial Sequence: Synthetic oligonucleotide
ucuucuucucuguccacaa

SEQ ID NO: 3358 - RNA, 19 nt, Artificial Sequence
  Description of Artificial Sequence: Synthetic oligonucleotide
gucuucuucucuguccaca

SEQ ID NO: 3359 - RNA, 19 nt, Artificial Sequence
  Description of Artificial Sequence: Synthetic oligonucleotide
ggucuucuucucuguccac

SEQ ID NO: 3360 - RNA, 19 nt, Artificial Sequence
  Description of Artificial Sequence: Synthetic oligonucleotide
uggucuucuucucugucca

SEQ ID NO: 3361 - RNA, 19 nt, Artificial Sequence
  Description of Artificial Sequence: Synthetic oligonucleotide
guggucuucuucucugucc

SEQ ID NO: 3362 - RNA, 19 nt, Artificial Sequence
  Description of Artificial Sequence: Synthetic oligonucleotide
cguggucuucuucucuguc

SEQ ID NO: 3363 - RNA, 19 nt, Artificial Sequence
  Description of Artificial Sequence: Synthetic oligonucleotide
ucguggucuucuucucugu

SEQ ID NO: 3364 - RNA, 19 nt, Artificial Sequence
  Description of Artificial Sequence: Synthetic oligonucleotide
gucguggucuucuucucug

SEQ ID NO: 3365 - RNA, 19 nt, Artificial Sequence
  Description of Artificial Sequence: Synthetic oligonucleotide
agucguggucuucuucucu

SEQ ID NO: 3366 - RNA, 19 nt, Artificial Sequence
  Description of Artificial Sequence: Synthetic oligonucleotide
cagucguggucuucuucuc

SEQ ID NO: 3367 - RNA, 19 nt, Artificial Sequence
  Description of Artificial Sequence: Synthetic oligonucleotide
ccagucguggucuucuucu

SEQ ID NO: 3368 - RNA, 19 nt, Artificial Sequence
  Description of Artificial Sequence: Synthetic oligonucleotide
uccagucguggucuucuuc

SEQ ID NO: 3369 - RNA, 19 nt, Artificial Sequence
  Description of Artificial Sequence: Synthetic oligonucleotide
cuccagucguggucuucuu

SEQ ID NO: 3370 - RNA, 19 nt, Artificial Sequence
  Description of Artificial Sequence: Synthetic oligonucleotide
ucuccagucguggucuucu

SEQ ID NO: 3371 - RNA, 19 nt, Artificial Sequence
  Description of Artificial Sequence: Synthetic oligonucleotide
uucuccagucguggucuuc

SEQ ID NO: 3372 - RNA, 19 nt, Artificial Sequence
  Description of Artificial Sequence: Synthetic oligonucleotide
cuucuccagucguggucuu

SEQ ID NO: 3373 - RNA, 19 nt, Artificial Sequence
  Description of Artificial Sequence: Synthetic oligonucleotide
gcuucuccagucguggucu

SEQ ID NO: 3374 - RNA, 19 nt, Artificial Sequence
  Description of Artificial Sequence: Synthetic oligonucleotide
ggcuucuccagucgugguc

SEQ ID NO: 3375 - RNA, 19 nt, Artificial Sequence
  Description of Artificial Sequence: Synthetic oligonucleotide
gggcuucuccagucguggu

SEQ ID NO: 3376 - RNA, 19 nt, Artificial Sequence
  Description of Artificial Sequence: Synthetic oligonucleotide
ggggcuucuccagucgugg

SEQ ID NO: 3377 - RNA, 19 nt, Artificial Sequence
  Description of Artificial Sequence: Synthetic oligonucleotide
gggggcuucuccagucgug

SEQ ID NO: 3378 - RNA, 19 nt, Artificial Sequence
  Description of Artificial Sequence: Synthetic oligonucleotide
agggggcuucuccagucgu

SEQ ID NO: 3379 - RNA, 19 nt, Artificial Sequence
  Description of Artificial Sequence: Synthetic oligonucleotide
aagggggcuucuccagucg

SEQ ID NO: 3380 - RNA, 19 nt, Artificial Sequence
  Description of Artificial Sequence: Synthetic oligonucleotide
aaagggggcuucuccaguc

SEQ ID NO: 3381 - RNA, 19 nt, Artificial Sequence
  Description of Artificial Sequence: Synthetic oligonucleotide
gaaagggggcuucuccagu

SEQ ID NO: 3382 - RNA, 19 nt, Artificial Sequence
  Description of Artificial Sequence: Synthetic oligonucleotide
agaaagggggcuucuccag

SEQ ID NO: 3383 - RNA, 19 nt, Artificial Sequence
  Description of Artificial Sequence: Synthetic oligonucleotide
cagaaagggggcuucucca

SEQ ID NO: 3384 - RNA, 19 nt, Artificial Sequence
  Description of Artificial Sequence: Synthetic oligonucleotide
ucagaaagggggcuucucc

SEQ ID NO: 3385 - RNA, 19 nt, Artificial Sequence
  Description of Artificial Sequence: Synthetic oligonucleotide
cucagaaagggggcuucuc

SEQ ID NO: 3386 - RNA, 19 nt, Artificial Sequence
  Description of Artificial Sequence: Synthetic oligonucleotide
acucagaaagggggcuucu

SEQ ID NO: 3387 - RNA, 19 nt, Artificial Sequence
  Description of Artificial Sequence: Synthetic oligonucleotide
cacucagaaagggggcuuc

SEQ ID NO: 3388 - RNA, 19 nt, Artificial Sequence
  Description of Artificial Sequence: Synthetic oligonucleotide
gcacucagaaagggggcuu

SEQ ID NO: 3389 - RNA, 19 nt, Artificial Sequence
  Description of Artificial Sequence: Synthetic oligonucleotide
ugcacucagaaagggggcu

SEQ ID NO: 3390 - RNA, 19 nt, Artificial Sequence
  Description of Artificial Sequence: Synthetic oligonucleotide
cugcacucagaaagggggc

SEQ ID NO: 3391 - RNA, 19 nt, Artificial Sequence
  Description of Artificial Sequence: Synthetic oligonucleotide
ccugcacucagaaaggggg

SEQ ID NO: 3392 - RNA, 19 nt, Artificial Sequence
  Description of Artificial Sequence: Synthetic oligonucleotide
cccugcacucagaaagggg

SEQ ID NO: 3393 - RNA, 19 nt, Artificial Sequence
  Description of Artificial Sequence: Synthetic oligonucleotide
ccccugcacucagaaaggg

SEQ ID NO: 3394 - RNA, 19 nt, Artificial Sequence
  Description of Artificial Sequence: Synthetic oligonucleotide
cccccugcacucagaaagg

SEQ ID NO: 3395 - RNA, 19 nt, Artificial Sequence
  Description of Artificial Sequence: Synthetic oligonucleotide
ccccccugcacucagaaag

SEQ ID NO: 3396 - RNA, 19 nt, Artificial Sequence
  Description of Artificial Sequence: Synthetic oligonucleotide
gccccccugcacucagaaa

SEQ ID NO: 3397 - RNA, 19 nt, Artificial Sequence
  Description of Artificial Sequence: Synthetic oligonucleotide
agccccccugcacucagaa

SEQ ID NO: 3398 - RNA, 19 nt, Artificial Sequence
  Description of Artificial Sequence: Synthetic oligonucleotide
cagccccccugcacucaga

SEQ ID NO: 3399 - RNA, 19 nt, Artificial Sequence
  Description of Artificial Sequence: Synthetic oligonucleotide
gcagccccccugcacucag

SEQ ID NO: 3400 - RNA, 19 nt, Artificial Sequence
  Description of Artificial Sequence: Synthetic oligonucleotide
ugcagccccccugcacuca

SEQ ID NO: 3401 - RNA, 19 nt, Artificial Sequence
  Description of Artificial Sequence: Synthetic oligonucleotide
augcagccccccugcacuc

SEQ ID NO: 3402 - RNA, 19 nt, Artificial Sequence
  Description of Artificial Sequence: Synthetic oligonucleotide
caugcagccccccugcacu

SEQ ID NO: 3403 - RNA, 19 nt, Artificial Sequence
  Description of Artificial Sequence: Synthetic oligonucleotide
gcaugcagccccccugcac

SEQ ID NO: 3404 - RNA, 19 nt, Artificial Sequence
  Description of Artificial Sequence: Synthetic oligonucleotide
cgcaugcagccccccugca

SEQ ID NO: 3405 - RNA, 19 nt, Artificial Sequence
  Description of Artificial Sequence: Synthetic oligonucleotide
acgcaugcagccccccugc

SEQ ID NO: 3406 - RNA, 19 nt, Artificial Sequence
  Description of Artificial Sequence: Synthetic oligonucleotide
aacgcaugcagccccccug

SEQ ID NO: 3407 - RNA, 19 nt, Artificial Sequence
  Description of Artificial Sequence: Synthetic oligonucleotide
caacgcaugcagccccccu

SEQ ID NO: 3408 - RNA, 19 nt, Artificial Sequence
  Description of Artificial Sequence: Synthetic oligonucleotide
gcaacgcaugcagcccccc

SEQ ID NO: 3409 - RNA, 19 nt, Artificial Sequence
  Description of Artificial Sequence: Synthetic oligonucleotide
ggcaacgcaugcagccccc

SEQ ID NO: 3410 - RNA, 19 nt, Artificial Sequence
  Description of Artificial Sequence: Synthetic oligonucleotide
aggcaacgcaugcagcccc

SEQ ID NO: 3411 - RNA, 19 nt, Artificial Sequence
  Description of Artificial Sequence: Synthetic oligonucleotide
gaggcaacgcaugcagccc

SEQ ID NO: 3412 - RNA, 19 nt, Artificial Sequence
  Description of Artificial Sequence: Synthetic oligonucleotide
ggaggcaacgcaugcagcc

SEQ ID NO: 3413 - RNA, 19 nt, Artificial Sequence
  Description of Artificial Sequence: Synthetic oligonucleotide
aggaggcaacgcaugcagc

SEQ ID NO: 3414 - RNA, 19 nt, Artificial Sequence
  Description of Artificial Sequence: Synthetic oligonucleotide
caggaggcaacgcaugcag

SEQ ID NO: 3415 - RNA, 19 nt, Artificial Sequence
  Description of Artificial Sequence: Synthetic oligonucleotide
ucaggaggcaacgcaugca

SEQ ID NO: 3416 - RNA, 19 nt, Artificial Sequence
  Description of Artificial Sequence: Synthetic oligonucleotide
cucaggaggcaacgcaugc

SEQ ID NO: 3417 - RNA, 19 nt, Artificial Sequence
  Description of Artificial Sequence: Synthetic oligonucleotide
ucucaggaggcaacgcaug

SEQ ID NO: 3418 - RNA, 19 nt, Artificial Sequence
  Description of Artificial Sequence: Synthetic oligonucleotide
aucucaggaggcaacgcau

SEQ ID NO: 3419 - RNA, 19 nt, Artificial Sequence
  Description of Artificial Sequence: Synthetic oligonucleotide
gaucucaggaggcaacgca

SEQ ID NO: 3420 - RNA, 19 nt, Artificial Sequence
  Description of Artificial Sequence: Synthetic oligonucleotide
cgaucucaggaggcaacgc

SEQ ID NO: 3421 - RNA, 19 nt, Artificial Sequence
  Description of Artificial Sequence: Synthetic oligonucleotide
ucgaucucaggaggcaacg

SEQ ID NO: 3422 - RNA, 19 nt, Artificial Sequence
  Description of Artificial Sequence: Synthetic oligonucleotide
cucgaucucaggaggcaac

SEQ ID NO: 3423 - RNA, 19 nt, Artificial Sequence
  Description of Artificial Sequence: Synthetic oligonucleotide
ccucgaucucaggaggcaa

SEQ ID NO: 3424 - RNA, 19 nt, Artificial Sequence
  Description of Artificial Sequence: Synthetic oligonucleotide
gccucgaucucaggaggca

SEQ ID NO: 3425 - RNA, 19 nt, Artificial Sequence
  Description of Artificial Sequence: Synthetic oligonucleotide
agccucgaucucaggaggc

SEQ ID NO: 3426 - RNA, 19 nt, Artificial Sequence
  Description of Artificial Sequence: Synthetic oligonucleotide
cagccucgaucucaggagg

SEQ ID NO: 3427 - RNA, 19 nt, Artificial Sequence
  Description of Artificial Sequence: Synthetic oligonucleotide
gcagccucgaucucaggag

SEQ ID NO: 3428 - RNA, 19 nt, Artificial Sequence
  Description of Artificial Sequence: Synthetic oligonucleotide
ugcagccucgaucucagga

SEQ ID NO: 3429 - RNA, 19 nt, Artificial Sequence
  Description of Artificial Sequence: Synthetic oligonucleotide
cugcagccucgaucucagg

SEQ ID NO: 3430 - RNA, 19 nt, Artificial Sequence
  Description of Artificial Sequence: Synthetic oligonucleotide
ccugcagccucgaucucag

SEQ ID NO: 3431 - RNA, 19 nt, Artificial Sequence
  Description of Artificial Sequence: Synthetic oligonucleotide
uccugcagccucgaucuca

SEQ ID NO: 3432 - RNA, 19 nt, Artificial Sequence
  Description of Artificial Sequence: Synthetic oligonucleotide
auccugcagccucgaucuc

SEQ ID NO: 3433 - RNA, 19 nt, Artificial Sequence
  Description of Artificial Sequence: Synthetic oligonucleotide
uauccugcagccucgaucu

SEQ ID NO: 3434 - RNA, 19 nt, Artificial Sequence
  Description of Artificial Sequence: Synthetic oligonucleotide
auauccugcagccucgauc

SEQ ID NO: 3435 - RNA, 19 nt, Artificial Sequence
  Description of Artificial Sequence: Synthetic oligonucleotide
cauauccugcagccucgau

SEQ ID NO: 3436 - RNA, 19 nt, Artificial Sequence
  Description of Artificial Sequence: Synthetic oligonucleotide
gcauauccugcagccucga

SEQ ID NO: 3437 - RNA, 19 nt, Artificial Sequence
  Description of Artificial Sequence: Synthetic oligonucleotide
agcauauccugcagccucg

SEQ ID NO: 3438 - RNA, 19 nt, Artificial Sequence
  Description of Artificial Sequence: Synthetic oligonucleotide
gagcauauccugcagccuc

SEQ ID NO: 3439 - RNA, 19 nt, Artificial Sequence
  Description of Artificial Sequence: Synthetic oligonucleotide
ugagcauauccugcagccu

SEQ ID NO: 3440 - RNA, 19 nt, Artificial Sequence
  Description of Artificial Sequence: Synthetic oligonucleotide
cugagcauauccugcagcc

SEQ ID NO: 3441 - RNA, 19 nt, Artificial Sequence
  Description of Artificial Sequence: Synthetic oligonucleotide
ucugagcauauccugcagc

SEQ ID NO: 3442 - RNA, 19 nt, Artificial Sequence
  Description of Artificial Sequence: Synthetic oligonucleotide
gucugagcauauccugcag

SEQ ID NO: 3443 - RNA, 19 nt, Artificial Sequence
  Description of Artificial Sequence: Synthetic oligonucleotide
agucugagcauauccugca

SEQ ID NO: 3444 - RNA, 19 nt, Artificial Sequence
  Description of Artificial Sequence: Synthetic oligonucleotide
gagucugagcauauccugc

SEQ ID NO: 3445 - RNA, 19 nt, Artificial Sequence
  Description of Artificial Sequence: Synthetic oligonucleotide
agagucugagcauauccug

SEQ ID NO: 3446 - RNA, 19 nt, Artificial Sequence
  Description of Artificial Sequence: Synthetic oligonucleotide
uagagucugagcauauccu

SEQ ID NO: 3447 - RNA, 19 nt, Artificial Sequence
  Description of Artificial Sequence: Synthetic oligonucleotide
cuagagucugagcauaucc

SEQ ID NO: 3448 - RNA, 19 nt, Artificial Sequence
  Description of Artificial Sequence: Synthetic oligonucleotide
ucuagagucugagcauauc

SEQ ID NO: 3449 - RNA, 19 nt, Artificial Sequence
  Description of Artificial Sequence: Synthetic oligonucleotide
cucuagagucugagcauau

SEQ ID NO: 3450 - RNA, 19 nt, Artificial Sequence
  Description of Artificial Sequence: Synthetic oligonucleotide
ccucuagagucugagcaua

SEQ ID NO: 3451 - RNA, 19 nt, Artificial Sequence
  Description of Artificial Sequence: Synthetic oligonucleotide
gccucuagagucugagcau

SEQ ID NO: 3452 - RNA, 19 nt, Artificial Sequence
  Description of Artificial Sequence: Synthetic oligonucleotide
cgccucuagagucugagca

SEQ ID NO: 3453 - RNA, 19 nt, Artificial Sequence
  Description of Artificial Sequence: Synthetic oligonucleotide
acgccucuagagucugagc

SEQ ID NO: 3454 - RNA, 19 nt, Artificial Sequence
  Description of Artificial Sequence: Synthetic oligonucleotide
cacgccucuagagucugag

SEQ ID NO: 3455 - RNA, 19 nt, Artificial Sequence
  Description of Artificial Sequence: Synthetic oligonucleotide
ccacgccucuagagucuga

SEQ ID NO: 3456 - RNA, 19 nt, Artificial Sequence
  Description of Artificial Sequence: Synthetic oligonucleotide
uccacgccucuagagucug

SEQ ID NO: 3457 - RNA, 19 nt, Artificial Sequence
  Description of Artificial Sequence: Synthetic oligonucleotide
guccacgccucuagagucu

SEQ ID NO: 3458 - RNA, 19 nt, Artificial Sequence
  Description of Artificial Sequence: Synthetic oligonucleotide
gguccacgccucuagaguc

SEQ ID NO: 3459 - RNA, 19 nt, Artificial Sequence
  Description of Artificial Sequence: Synthetic oligonucleotide
ugguccacgccucuagagu

SEQ ID NO: 3460 - RNA, 19 nt, Artificial Sequence
  Description of Artificial Sequence: Synthetic oligonucleotide
uugguccacgccucuagag

SEQ ID NO: 3461 - RNA, 19 nt, Artificial Sequence
  Description of Artificial Sequence: Synthetic oligonucleotide
cuugguccacgccucuaga

SEQ ID NO: 3462 - RNA, 19 nt, Artificial Sequence
  Description of Artificial Sequence: Synthetic oligonucleotide
ccuugguccacgccucuag

SEQ ID NO: 3463 - RNA, 19 nt, Artificial Sequence
  Description of Artificial Sequence: Synthetic oligonucleotide
cccuugguccacgccucua

SEQ ID NO: 3464 - RNA, 19 nt, Artificial Sequence
  Description of Artificial Sequence: Synthetic oligonucleotide
ccccuugguccacgccucu

SEQ ID NO: 3465 - RNA, 19 nt, Artificial Sequence
  Description of Artificial Sequence: Synthetic oligonucleotide
gccccuugguccacgccuc

SEQ ID NO: 3466 - RNA, 19 nt, Artificial Sequence
  Description of Artificial Sequence: Synthetic oligonucleotide
ugccccuugguccacgccu

SEQ ID NO: 3467 - RNA, 19 nt, Artificial Sequence
  Description of Artificial Sequence: Synthetic oligonucleotide
augccccuugguccacgcc

SEQ ID NO: 3468 - RNA, 19 nt, Artificial Sequence
  Description of Artificial Sequence: Synthetic oligonucleotide
caugccccuugguccacgc

SEQ ID NO: 3469 - RNA, 19 nt, Artificial Sequence
  Description of Artificial Sequence: Synthetic oligonucleotide
ccaugccccuugguccacg

SEQ ID NO: 3470 - RNA, 19 nt, Artificial Sequence
  Description of Artificial Sequence: Synthetic oligonucleotide
uccaugccccuugguccac

SEQ ID NO: 3471 - RNA, 19 nt, Artificial Sequence
  Description of Artificial Sequence: Synthetic oligonucleotide
cuccaugccccuuggucca

SEQ ID NO: 3472 - RNA, 19 nt, Artificial Sequence
  Description of Artificial Sequence: Synthetic oligonucleotide
gcuccaugccccuuggucc

SEQ ID NO: 3473 - RNA, 19 nt, Artificial Sequence
  Description of Artificial Sequence: Synthetic oligonucleotide
agcuccaugccccuugguc

SEQ ID NO: 3474 - RNA, 19 nt, Artificial Sequence
  Description of Artificial Sequence: Synthetic oligonucleotide
aagcuccaugccccuuggu

SEQ ID NO: 3475 - RNA, 19 nt, Artificial Sequence
  Description of Artificial Sequence: Synthetic oligonucleotide
gaagcuccaugccccuugg

SEQ ID NO: 3476 - RNA, 19 nt, Artificial Sequence
  Description of Artificial Sequence: Synthetic oligonucleotide
ugaagcuccaugccccuug

SEQ ID NO: 3477 - RNA, 19 nt, Artificial Sequence
  Description of Artificial Sequence: Synthetic oligonucleotide
gugaagcuccaugccccuu

SEQ ID NO: 3478 - RNA, 19 nt, Artificial Sequence
  Description of Artificial Sequence: Synthetic oligonucleotide
agugaagcuccaugccccu

SEQ ID NO: 3479 - RNA, 19 nt, Artificial Sequence
  Description of Artificial Sequence: Synthetic oligonucleotide
gagugaagcuccaugcccc

SEQ ID NO: 3480 - RNA, 19 nt, Artificial Sequence
  Description of Artificial Sequence: Synthetic oligonucleotide
ggagugaagcuccaugccc

SEQ ID NO: 3481 - RNA, 19 nt, Artificial Sequence
  Description of Artificial Sequence: Synthetic oligonucleotide
aggagugaagcuccaugcc

SEQ ID NO: 3482 - RNA, 19 nt, Artificial Sequence
  Description of Artificial Sequence: Synthetic oligonucleotide
aaggagugaagcuccaugc

SEQ ID NO: 3483 - RNA, 19 nt, Artificial Sequence
  Description of Artificial Sequence: Synthetic oligonucleotide
caaggagugaagcuccaug

SEQ ID NO: 3484 - RNA, 19 nt, Artificial Sequence
  Description of Artificial Sequence: Synthetic oligonucleotide
gcaaggagugaagcuccau

SEQ ID NO: 3485 - RNA, 19 nt, Artificial Sequence
  Description of Artificial Sequence: Synthetic oligonucleotide
agcaaggagugaagcucca

SEQ ID NO: 3486 - RNA, 19 nt, Artificial Sequence
  Description of Artificial Sequence: Synthetic oligonucleotide
cagcaaggagugaagcucc

SEQ ID NO: 3487 - RNA, 19 nt, Artificial Sequence
  Description of Artificial Sequence: Synthetic oligonucleotide
ccagcaaggagugaagcuc

SEQ ID NO: 3488 - RNA, 19 nt, Artificial Sequence
  Description of Artificial Sequence: Synthetic oligonucleotide
gccagcaaggagugaagcu

SEQ ID NO: 3489 - RNA, 19 nt, Artificial Sequence
  Description of Artificial Sequence: Synthetic oligonucleotide
ggccagcaaggagugaagc

SEQ ID NO: 3490 - RNA, 19 nt, Artificial Sequence
  Description of Artificial Sequence: Synthetic oligonucleotide
uggccagcaaggagugaag

SEQ ID NO: 3491 - RNA, 19 nt, Artificial Sequence
  Description of Artificial Sequence: Synthetic oligonucleotide
cuggccagcaaggagugaa

SEQ ID NO: 3492 - RNA, 19 nt, Artificial Sequence
  Description of Artificial Sequence: Synthetic oligonucleotide
ccuggccagcaaggaguga

SEQ ID NO: 3493 - RNA, 19 nt, Artificial Sequence
  Description of Artificial Sequence: Synthetic oligonucleotide
cccuggccagcaaggagug

SEQ ID NO: 3494 - RNA, 19 nt, Artificial Sequence
  Description of Artificial Sequence: Synthetic oligonucleotide
ucccuggccagcaaggagu

SEQ ID NO: 3495 - RNA, 19 nt, Artificial Sequence
  Description of Artificial Sequence: Synthetic oligonucleotide
cucccuggccagcaaggag

SEQ ID NO: 3496 - RNA, 19 nt, Artificial Sequence
  Description of Artificial Sequence: Synthetic oligonucleotide
acucccuggccagcaagga

SEQ ID NO: 3497 - RNA, 19 nt, Artificial Sequence
  Description of Artificial Sequence: Synthetic oligonucleotide
aacucccuggccagcaagg

SEQ ID NO: 3498 - RNA, 19 nt, Artificial Sequence
  Description of Artificial Sequence: Synthetic oligonucleotide
caacucccuggccagcaag

SEQ ID NO: 3499 - RNA, 19 nt, Artificial Sequence
  Description of Artificial Sequence: Synthetic oligonucleotide
ccaacucccuggccagcaa

SEQ ID NO: 3500 - RNA, 19 nt, Artificial Sequence
  Description of Artificial Sequence: Synthetic oligonucleotide
cccaacucccuggccagca

SEQ ID NO: 3501 - RNA, 19 nt, Artificial Sequence
  Description of Artificial Sequence: Synthetic oligonucleotide
ccccaacucccuggccagc

SEQ ID NO: 3502 - RNA, 19 nt, Artificial Sequence
  Description of Artificial Sequence: Synthetic oligonucleotide
uccccaacucccuggccag

SEQ ID NO: 3503 - RNA, 19 nt, Artificial Sequence
  Description of Artificial Sequence: Synthetic oligonucleotide
guccccaacucccuggcca

SEQ ID NO: 3504 - RNA, 19 nt, Artificial Sequence
  Description of Artificial Sequence: Synthetic oligonucleotide
aguccccaacucccuggcc

SEQ ID NO: 3505 - RNA, 19 nt, Artificial Sequence
  Description of Artificial Sequence: Synthetic oligonucleotide
gaguccccaacucccuggc

SEQ ID NO: 3506 - RNA, 19 nt, Artificial Sequence
  Description of Artificial Sequence: Synthetic oligonucleotide
ugaguccccaacucccugg

SEQ ID NO: 3507 - RNA, 19 nt, Artificial Sequence
  Description of Artificial Sequence: Synthetic oligonucleotide
cugaguccccaacucccug

SEQ ID NO: 3508 - RNA, 19 nt, Artificial Sequence
  Description of Artificial Sequence: Synthetic oligonucleotide
ucugaguccccaacucccu

SEQ ID NO: 3509 - RNA, 19 nt, Artificial Sequence
  Description of Artificial Sequence: Synthetic oligonucleotide
cucugaguccccaacuccc

SEQ ID NO: 3510 - RNA, 19 nt, Artificial Sequence
  Description of Artificial Sequence: Synthetic oligonucleotide
ccucugaguccccaacucc

SEQ ID NO: 3511 - RNA, 19 nt, Artificial Sequence
  Description of Artificial Sequence: Synthetic oligonucleotide
cccucugaguccccaacuc

SEQ ID NO: 3512 - RNA, 19 nt, Artificial Sequence
  Description of Artificial Sequence: Synthetic oligonucleotide
ucccucugaguccccaacu

SEQ ID NO: 3513 - RNA, 19 nt, Artificial Sequence
  Description of Artificial Sequence: Synthetic oligonucleotide
gucccucugaguccccaac

SEQ ID NO: 3514 - RNA, 19 nt, Artificial Sequence
  Description of Artificial Sequence: Synthetic oligonucleotide
ggucccucugaguccccaa

SEQ ID NO: 3515 - RNA, 19 nt, Artificial Sequence
  Description of Artificial Sequence: Synthetic oligonucleotide
uggucccucugagucccca

SEQ ID NO: 3516 - RNA, 19 nt, Artificial Sequence
  Description of Artificial Sequence: Synthetic oligonucleotide
guggucccucugagucccc

SEQ ID NO: 3517 - RNA, 19 nt, Artificial Sequence
  Description of Artificial Sequence: Synthetic oligonucleotide
aguggucccucugaguccc

SEQ ID NO: 3518 - RNA, 19 nt, Artificial Sequence
  Description of Artificial Sequence: Synthetic oligonucleotide
aaguggucccucugagucc

SEQ ID NO: 3519 - RNA, 19 nt, Artificial Sequence
  Description of Artificial Sequence: Synthetic oligonucleotide
caaguggucccucugaguc

SEQ ID NO: 3520 - RNA, 19 nt, Artificial Sequence
  Description of Artificial Sequence: Synthetic oligonucleotide
ccaaguggucccucugagu

SEQ ID NO: 3521 - RNA, 19 nt, Artificial Sequence
  Description of Artificial Sequence: Synthetic oligonucleotide
cccaaguggucccucugag

SEQ ID NO: 3522 - RNA, 19 nt, Artificial Sequence
  Description of Artificial Sequence: Synthetic oligonucleotide
ccccaaguggucccucuga

SEQ ID NO: 3523 - RNA, 19 nt, Artificial Sequence
  Description of Artificial Sequence: Synthetic oligonucleotide
gccccaaguggucccucug

SEQ ID NO: 3524 - RNA, 19 nt, Artificial Sequence
  Description of Artificial Sequence: Synthetic oligonucleotide
ggccccaaguggucccucu

SEQ ID NO: 3525 - RNA, 19 nt, Artificial Sequence
  Description of Artificial Sequence: Synthetic oligonucleotide
uggccccaaguggucccuc

SEQ ID NO: 3526 - RNA, 19 nt, Artificial Sequence
  Description of Artificial Sequence: Synthetic oligonucleotide
cuggccccaaguggucccu

SEQ ID NO: 3527 - RNA, 19 nt, Artificial Sequence
  Description of Artificial Sequence: Synthetic oligonucleotide
gcuggccccaagugguccc

SEQ ID NO: 3528 - RNA, 19 nt, Artificial Sequence
  Description of Artificial Sequence: Synthetic oligonucleotide
ggcuggccccaaguggucc

SEQ ID NO: 3529 - RNA, 19 nt, Artificial Sequence
  Description of Artificial Sequence: Synthetic oligonucleotide
uggcuggccccaagugguc

SEQ ID NO: 3530 - RNA, 19 nt, Artificial Sequence
  Description of Artificial Sequence: Synthetic oligonucleotide
cuggcuggccccaaguggu

SEQ ID NO: 3531 - RNA, 19 nt, Artificial Sequence
  Description of Artificial Sequence: Synthetic oligonucleotide
ucuggcuggccccaagugg

SEQ ID NO: 3532 - RNA, 19 nt, Artificial Sequence
  Description of Artificial Sequence: Synthetic oligonucleotide
gucuggcuggccccaagug

SEQ ID NO: 3533 - RNA, 19 nt, Artificial Sequence
  Description of Artificial Sequence: Synthetic oligonucleotide
agucuggcuggccccaagu

SEQ ID NO: 3534 - RNA, 19 nt, Artificial Sequence
  Description of Artificial Sequence: Synthetic oligonucleotide
cagucuggcuggccccaag

SEQ ID NO: 3535 - RNA, 19 nt, Artificial Sequence
  Description of Artificial Sequence: Synthetic oligonucleotide
ccagucuggcuggccccaa

SEQ ID NO: 3536 - RNA, 19 nt, Artificial Sequence
  Description of Artificial Sequence: Synthetic oligonucleotide
gccagucuggcuggcccca

SEQ ID NO: 3537 - RNA, 19 nt, Artificial Sequence
  Description of Artificial Sequence: Synthetic oligonucleotide
ggccagucuggcuggcccc

SEQ ID NO: 3538 - RNA, 19 nt, Artificial Sequence
  Description of Artificial Sequence: Synthetic oligonucleotide
aggccagucuggcuggccc

SEQ ID NO: 3539 - RNA, 19 nt, Artificial Sequence
  Description of Artificial Sequence: Synthetic oligonucleotide
gaggccagucuggcuggcc

SEQ ID NO: 3540 - RNA, 19 nt, Artificial Sequence
  Description of Artificial Sequence: Synthetic oligonucleotide
ugaggccagucuggcuggc

SEQ ID NO: 3541 - RNA, 19 nt, Artificial Sequence
  Description of Artificial Sequence: Synthetic oligonucleotide
uugaggccagucuggcugg

SEQ ID NO: 3542 - RNA, 19 nt, Artificial Sequence
  Description of Artificial Sequence: Synthetic oligonucleotide
auugaggccagucuggcug

SEQ ID NO: 3543 - RNA, 19 nt, Artificial Sequence
  Description of Artificial Sequence: Synthetic oligonucleotide
cauugaggccagucuggcu

SEQ ID NO: 3544 - RNA, 19 nt, Artificial Sequence
  Description of Artificial Sequence: Synthetic oligonucleotide
ccauugaggccagucuggc

SEQ ID NO: 3545 - RNA, 19 nt, Artificial Sequence
  Description of Artificial Sequence: Synthetic oligonucleotide
gccauugaggccagucugg

SEQ ID NO: 3546 - RNA, 19 nt, Artificial Sequence
  Description of Artificial Sequence: Synthetic oligonucleotide
cgccauugaggccagucug

SEQ ID NO: 3547 - RNA, 19 nt, Artificial Sequence
  Description of Artificial Sequence: Synthetic oligonucleotide
ccgccauugaggccagucu

SEQ ID NO: 3548 - RNA, 19 nt, Artificial Sequence
  Description of Artificial Sequence: Synthetic oligonucleotide
uccgccauugaggccaguc

SEQ ID NO: 3549 - RNA, 19 nt, Artificial Sequence
  Description of Artificial Sequence: Synthetic oligonucleotide
guccgccauugaggccagu

SEQ ID NO: 3550 - RNA, 19 nt, Artificial Sequence
  Description of Artificial Sequence: Synthetic oligonucleotide
aguccgccauugaggccag

SEQ ID NO: 3551 - RNA, 19 nt, Artificial Sequence
  Description of Artificial Sequence: Synthetic oligonucleotide
gaguccgccauugaggcca

SEQ ID NO: 3552 - RNA, 19 nt, Artificial Sequence
  Description of Artificial Sequence: Synthetic oligonucleotide
ugaguccgccauugaggcc

SEQ ID NO: 3553 - RNA, 19 nt, Artificial Sequence
  Description of Artificial Sequence: Synthetic oligonucleotide
cugaguccgccauugaggc

SEQ ID NO: 3554 - RNA, 19 nt, Artificial Sequence
  Description of Artificial Sequence: Synthetic oligonucleotide
acugaguccgccauugagg

SEQ ID NO: 3555 - RNA, 19 nt, Artificial Sequence
  Description of Artificial Sequence: Synthetic oligonucleotide
gacugaguccgccauugag

SEQ ID NO: 3556 - RNA, 19 nt, Artificial Sequence
  Description of Artificial Sequence: Synthetic oligonucleotide
ugacugaguccgccauuga

SEQ ID NO: 3557 - RNA, 19 nt, Artificial Sequence
  Description of Artificial Sequence: Synthetic oligonucleotide
gugacugaguccgccauug

SEQ ID NO: 3558 - RNA, 19 nt, Artificial Sequence
  Description of Artificial Sequence: Synthetic oligonucleotide
ugugacugaguccgccauu

SEQ ID NO: 3559 - RNA, 19 nt, Artificial Sequence
  Description of Artificial Sequence: Synthetic oligonucleotide
augugacugaguccgccau

SEQ ID NO: 3560 - RNA, 19 nt, Artificial Sequence
  Description of Artificial Sequence: Synthetic oligonucleotide
aaugugacugaguccgcca

SEQ ID NO: 3561 - RNA, 19 nt, Artificial Sequence
  Description of Artificial Sequence: Synthetic oligonucleotide
caaugugacugaguccgcc

SEQ ID NO: 3562 - RNA, 19 nt, Artificial Sequence
  Description of Artificial Sequence: Synthetic oligonucleotide
ucaaugugacugaguccgc

SEQ ID NO: 3563 - RNA, 19 nt, Artificial Sequence
  Description of Artificial Sequence: Synthetic oligonucleotide
gucaaugugacugaguccg

SEQ ID NO: 3564 - RNA, 19 nt, Artificial Sequence
  Description of Artificial Sequence: Synthetic oligonucleotide
agucaaugugacugagucc

SEQ ID NO: 3565 - RNA, 19 nt, Artificial Sequence
  Description of Artificial Sequence: Synthetic oligonucleotide
cagucaaugugacugaguc

SEQ ID NO: 3566 - RNA, 19 nt, Artificial Sequence
  Description of Artificial Sequence: Synthetic oligonucleotide
ucagucaaugugacugagu

SEQ ID NO: 3567 - RNA, 19 nt, Artificial Sequence
  Description of Artificial Sequence: Synthetic oligonucleotide
gucagucaaugugacugag

SEQ ID NO: 3568 - RNA, 19 nt, Artificial Sequence
  Description of Artificial Sequence: Synthetic oligonucleotide
cgucagucaaugugacuga

SEQ ID NO: 3569 - RNA, 19 nt, Artificial Sequence
  Description of Artificial Sequence: Synthetic oligonucleotide
ccgucagucaaugugacug

SEQ ID NO: 3570 - RNA, 19 nt, Artificial Sequence
  Description of Artificial Sequence: Synthetic oligonucleotide
cccgucagucaaugugacu

SEQ ID NO: 3571 - RNA, 19 nt, Artificial Sequence
  Description of Artificial Sequence: Synthetic oligonucleotide
ccccgucagucaaugugac

SEQ ID NO: 3572 - RNA, 19 nt, Artificial Sequence
  Description of Artificial Sequence: Synthetic oligonucleotide
uccccgucagucaauguga

SEQ ID NO: 3573 - RNA, 19 nt, Artificial Sequence
  Description of Artificial Sequence: Synthetic oligonucleotide
guccccgucagucaaugug

SEQ ID NO: 3574 - RNA, 19 nt, Artificial Sequence
  Description of Artificial Sequence: Synthetic oligonucleotide
gguccccgucagucaaugu

SEQ ID NO: 3575 - RNA, 19 nt, Artificial Sequence
  Description of Artificial Sequence: Synthetic oligonucleotide
ugguccccgucagucaaug

SEQ ID NO: 3576 - RNA, 19 nt, Artificial Sequence
  Description of Artificial Sequence: Synthetic oligonucleotide
cugguccccgucagucaau

SEQ ID NO: 3577 - RNA, 19 nt, Artificial Sequence
  Description of Artificial Sequence: Synthetic oligonucleotide
ccugguccccgucagucaa

SEQ ID NO: 3578 - RNA, 19 nt, Artificial Sequence
  Description of Artificial Sequence: Synthetic oligonucleotide
cccugguccccgucaguca

SEQ ID NO: 3579 - RNA, 19 nt, Artificial Sequence
  Description of Artificial Sequence: Synthetic oligonucleotide
gcccugguccccgucaguc

SEQ ID NO: 3580 - RNA, 19 nt, Artificial Sequence
  Description of Artificial Sequence: Synthetic oligonucleotide
agcccugguccccgucagu

SEQ ID NO: 3581 - RNA, 19 nt, Artificial Sequence
  Description of Artificial Sequence: Synthetic oligonucleotide
aagcccugguccccgucag

SEQ ID NO: 3582 - RNA, 19 nt, Artificial Sequence
  Description of Artificial Sequence: Synthetic oligonucleotide
caagcccugguccccguca

SEQ ID NO: 3583 - RNA, 19 nt, Artificial Sequence
  Description of Artificial Sequence: Synthetic oligonucleotide
acaagcccugguccccguc

SEQ ID NO: 3584 - RNA, 19 nt, Artificial Sequence
  Description of Artificial Sequence: Synthetic oligonucleotide
cacaagcccugguccccgu

SEQ ID NO: 3585 - RNA, 19 nt, Artificial Sequence
  Description of Artificial Sequence: Synthetic oligonucleotide
acacaagcccugguccccg

SEQ ID NO: 3586 - RNA, 19 nt, Artificial Sequence
  Description of Artificial Sequence: Synthetic oligonucleotide
cacacaagcccuggucccc

SEQ ID NO: 3587 - RNA, 19 nt, Artificial Sequence
  Description of Artificial Sequence: Synthetic oligonucleotide
ccacacaagcccugguccc

SEQ ID NO: 3588 - RNA, 19 nt, Artificial Sequence
  Description of Artificial Sequence: Synthetic oligonucleotide
cccacacaagcccuggucc

SEQ ID NO: 3589 - RNA, 19 nt, Artificial Sequence
  Description of Artificial Sequence: Synthetic oligonucleotide
acccacacaagcccugguc

SEQ ID NO: 3590 - RNA, 19 nt, Artificial Sequence
  Description of Artificial Sequence: Synthetic oligonucleotide
gacccacacaagcccuggu

SEQ ID NO: 3591 - RNA, 19 nt, Artificial Sequence
  Description of Artificial Sequence: Synthetic oligonucleotide
cgacccacacaagcccugg

SEQ ID NO: 3592 - RNA, 19 nt, Artificial Sequence
  Description of Artificial Sequence: Synthetic oligonucleotide
ucgacccacacaagcccug

SEQ ID NO: 3593 - RNA, 19 nt, Artificial Sequence
  Description of Artificial Sequence: Synthetic oligonucleotide
cucgacccacacaagcccu

SEQ ID NO: 3594 - RNA, 19 nt, Artificial Sequence
  Description of Artificial Sequence: Synthetic oligonucleotide
ucucgacccacacaagccc

SEQ ID NO: 3595 - RNA, 19 nt, Artificial Sequence
  Description of Artificial Sequence: Synthetic oligonucleotide
cucucgacccacacaagcc

SEQ ID NO: 3596 - RNA, 19 nt, Artificial Sequence
  Description of Artificial Sequence: Synthetic oligonucleotide
gcucucgacccacacaagc

SEQ ID NO: 3597 - RNA, 19 nt, Artificial Sequence
  Description of Artificial Sequence: Synthetic oligonucleotide
cgcucucgacccacacaag

SEQ ID NO: 3598 - RNA, 19 nt, Artificial Sequence
  Description of Artificial Sequence: Synthetic oligonucleotide
gcgcucucgacccacacaa

SEQ ID NO: 3599 - RNA, 19 nt, Artificial Sequence
  Description of Artificial Sequence: Synthetic oligonucleotide
ggcgcucucgacccacaca

SEQ ID NO: 3600 - RNA, 19 nt, Artificial Sequence
  Description of Artificial Sequence: Synthetic oligonucleotide
gggcgcucucgacccacac

SEQ ID NO: 3601 - RNA, 19 nt, Artificial Sequence
  Description of Artificial Sequence: Synthetic oligonucleotide
agggcgcucucgacccaca

SEQ ID NO: 3602 - RNA, 19 nt, Artificial Sequence
  Description of Artificial Sequence: Synthetic oligonucleotide
gagggcgcucucgacccac

SEQ ID NO: 3603 - RNA, 19 nt, Artificial Sequence
  Description of Artificial Sequence: Synthetic oligonucleotide
ugagggcgcucucgaccca

SEQ ID NO: 3604 - RNA, 19 nt, Artificial Sequence
  Description of Artificial Sequence: Synthetic oligonucleotide
augagggcgcucucgaccc

SEQ ID NO: 3605 - RNA, 19 nt, Artificial Sequence
  Description of Artificial Sequence: Synthetic oligonucleotide
caugagggcgcucucgacc

SEQ ID NO: 3606 - RNA, 19 nt, Artificial Sequence
  Description of Artificial Sequence: Synthetic oligonucleotide
ccaugagggcgcucucgac

SEQ ID NO: 3607 - RNA, 19 nt, Artificial Sequence
  Description of Artificial Sequence: Synthetic oligonucleotide
accaugagggcgcucucga

SEQ ID NO: 3608 - RNA, 19 nt, Artificial Sequence
  Description of Artificial Sequence: Synthetic oligonucleotide
caccaugagggcgcucucg

SEQ ID NO: 3609 - RNA, 19 nt, Artificial Sequence
  Description of Artificial Sequence: Synthetic oligonucleotide
gcaccaugagggcgcucuc

SEQ ID NO: 3610 - RNA, 19 nt, Artificial Sequence
  Description of Artificial Sequence: Synthetic oligonucleotide
agcaccaugagggcgcucu

SEQ ID NO: 3611 - RNA, 19 nt, Artificial Sequence
  Description of Artificial Sequence: Synthetic oligonucleotide
cagcaccaugagggcgcuc

SEQ ID NO: 3612 - RNA, 19 nt, Artificial Sequence
  Description of Artificial Sequence: Synthetic oligonucleotide
ccagcaccaugagggcgcu

SEQ ID NO: 3613 - RNA, 19 nt, Artificial Sequence
  Description of Artificial Sequence: Synthetic oligonucleotide
accagcaccaugagggcgc

SEQ ID NO: 3614 - RNA, 19 nt, Artificial Sequence
  Description of Artificial Sequence: Synthetic oligonucleotide
caccagcaccaugagggcg

SEQ ID NO: 3615 - RNA, 19 nt, Artificial Sequence
  Description of Artificial Sequence: Synthetic oligonucleotide
gcaccagcaccaugagggc

SEQ ID NO: 3616 - RNA, 19 nt, Artificial Sequence
  Description of Artificial Sequence: Synthetic oligonucleotide
agcaccagcaccaugaggg

SEQ ID NO: 3617 - RNA, 19 nt, Artificial Sequence
  Description of Artificial Sequence: Synthetic oligonucleotide
cagcaccagcaccaugagg

SEQ ID NO: 3618 - RNA, 19 nt, Artificial Sequence
  Description of Artificial Sequence: Synthetic oligonucleotide
acagcaccagcaccaugag

SEQ ID NO: 3619 - RNA, 19 nt, Artificial Sequence
  Description of Artificial Sequence: Synthetic oligonucleotide
aacagcaccagcaccauga

SEQ ID NO: 3620 - RNA, 19 nt, Artificial Sequence
  Description of Artificial Sequence: Synthetic oligonucleotide
caacagcaccagcaccaug

SEQ ID NO: 3621 - RNA, 19 nt, Artificial Sequence
  Description of Artificial Sequence: Synthetic oligonucleotide
acaacagcaccagcaccau

SEQ ID NO: 3622 - RNA, 19 nt, Artificial Sequence
  Description of Artificial Sequence: Synthetic oligonucleotide
cacaacagcaccagcacca

SEQ ID NO: 3623 - RNA, 19 nt, Artificial Sequence
  Description of Artificial Sequence: Synthetic oligonucleotide
acacaacagcaccagcacc

SEQ ID NO: 3624 - RNA, 19 nt, Artificial Sequence
  Description of Artificial Sequence: Synthetic oligonucleotide
cacacaacagcaccagcac

SEQ ID NO: 3625 - RNA, 19 nt, Artificial Sequence
  Description of Artificial Sequence: Synthetic oligonucleotide
acacacaacagcaccagca

SEQ ID NO: 3626 - RNA, 19 nt, Artificial Sequence
  Description of Artificial Sequence: Synthetic oligonucleotide
uacacacaacagcaccagc

SEQ ID NO: 3627 - RNA, 19 nt, Artificial Sequence
  Description of Artificial Sequence: Synthetic oligonucleotide
cuacacacaacagcaccag

SEQ ID NO: 3628 - RNA, 19 nt, Artificial Sequence
  Description of Artificial Sequence: Synthetic oligonucleotide
ccuacacacaacagcacca

SEQ ID NO: 3629 - RNA, 19 nt, Artificial Sequence
  Description of Artificial Sequence: Synthetic oligonucleotide
accuacacacaacagcacc

SEQ ID NO: 3630 - RNA, 19 nt, Artificial Sequence
  Description of Artificial Sequence: Synthetic oligonucleotide
gaccuacacacaacagcac

SEQ ID NO: 3631 - RNA, 19 nt, Artificial Sequence
  Description of Artificial Sequence: Synthetic oligonucleotide
ggaccuacacacaacagca

SEQ ID NO: 3632 - RNA, 19 nt, Artificial Sequence
  Description of Artificial Sequence: Synthetic oligonucleotide
gggaccuacacacaacagc

SEQ ID NO: 3633 - RNA, 19 nt, Artificial Sequence
  Description of Artificial Sequence: Synthetic oligonucleotide
ggggaccuacacacaacag

SEQ ID NO: 3634 - RNA, 19 nt, Artificial Sequence
  Description of Artificial Sequence: Synthetic oligonucleotide
aggggaccuacacacaaca

SEQ ID NO: 3635 - RNA, 19 nt, Artificial Sequence
  Description of Artificial Sequence: Synthetic oligonucleotide
caggggaccuacacacaac

SEQ ID NO: 3636 - RNA, 19 nt, Artificial Sequence
  Description of Artificial Sequence: Synthetic oligonucleotide
ccaggggaccuacacacaa

SEQ ID NO: 3637 - RNA, 19 nt, Artificial Sequence
  Description of Artificial Sequence: Synthetic oligonucleotide
cccaggggaccuacacaca

SEQ ID NO: 3638 - RNA, 19 nt, Artificial Sequence
  Description of Artificial Sequence: Synthetic oligonucleotide
ccccaggggaccuacacac

SEQ ID NO: 3639 - RNA, 19 nt, Artificial Sequence
  Description of Artificial Sequence: Synthetic oligonucleotide
uccccaggggaccuacaca

SEQ ID NO: 3640 - RNA, 19 nt, Artificial Sequence
  Description of Artificial Sequence: Synthetic oligonucleotide
guccccaggggaccuacac

SEQ ID NO: 3641 - RNA, 19 nt, Artificial Sequence
  Description of Artificial Sequence: Synthetic oligonucleotide
uguccccaggggaccuaca

SEQ ID NO: 3642 - RNA, 19 nt, Artificial Sequence
  Description of Artificial Sequence: Synthetic oligonucleotide
guguccccaggggaccuac

SEQ ID NO: 3643 - RNA, 19 nt, Artificial Sequence
  Description of Artificial Sequence: Synthetic oligonucleotide
uguguccccaggggaccua

SEQ ID NO: 3644 - RNA, 19 nt, Artificial Sequence
  Description of Artificial Sequence: Synthetic oligonucleotide
uuguguccccaggggaccu

SEQ ID NO: 3645 - RNA, 19 nt, Artificial Sequence
  Description of Artificial Sequence: Synthetic oligonucleotide
cuuguguccccaggggacc

SEQ ID NO: 3646 - RNA, 19 nt, Artificial Sequence
  Description of Artificial Sequence: Synthetic oligonucleotide
gcuuguguccccaggggac

SEQ ID NO: 3647 - RNA, 19 nt, Artificial Sequence
  Description of Artificial Sequence: Synthetic oligonucleotide
ugcuuguguccccagggga

SEQ ID NO: 3648 - RNA, 19 nt, Artificial Sequence
  Description of Artificial Sequence: Synthetic oligonucleotide
cugcuuguguccccagggg

SEQ ID NO: 3649 - RNA, 19 nt, Artificial Sequence
  Description of Artificial Sequence: Synthetic oligonucleotide
ccugcuuguguccccaggg

SEQ ID NO: 3650 - RNA, 19 nt, Artificial Sequence
  Description of Artificial Sequence: Synthetic oligonucleotide
gccugcuuguguccccagg

SEQ ID NO: 3651 - RNA, 19 nt, Artificial Sequence
  Description of Artificial Sequence: Synthetic oligonucleotide
cgccugcuuguguccccag

SEQ ID NO: 3652 - RNA, 19 nt, Artificial Sequence
  Description of Artificial Sequence: Synthetic oligonucleotide
gcgccugcuugugucccca

SEQ ID NO: 3653 - RNA, 19 nt, Artificial Sequence
  Description of Artificial Sequence: Synthetic oligonucleotide
ggcgccugcuugugucccc

SEQ ID NO: 3654 - RNA, 19 nt, Artificial Sequence
  Description of Artificial Sequence: Synthetic oligonucleotide
uggcgccugcuuguguccc

SEQ ID NO: 3655 - RNA, 19 nt, Artificial Sequence
  Description of Artificial Sequence: Synthetic oligonucleotide
uuggcgccugcuugugucc

SEQ ID NO: 3656 - RNA, 19 nt, Artificial Sequence
  Description of Artificial Sequence: Synthetic oligonucleotide
auuggcgccugcuuguguc

SEQ ID NO: 3657 - RNA, 19 nt, Artificial Sequence
  Description of Artificial Sequence: Synthetic oligonucleotide
cauuggcgccugcuugugu

SEQ ID NO: 3658 - RNA, 19 nt, Artificial Sequence
  Description of Artificial Sequence: Synthetic oligonucleotide
ccauuggcgccugcuugug

SEQ ID NO: 3659 - RNA, 19 nt, Artificial Sequence
  Description of Artificial Sequence: Synthetic oligonucleotide
accauuggcgccugcuugu

SEQ ID NO: 3660 - RNA, 19 nt, Artificial Sequence
  Description of Artificial Sequence: Synthetic oligonucleotide
uaccauuggcgccugcuug

SEQ ID NO: 3661 - RNA, 19 nt, Artificial Sequence
  Description of Artificial Sequence: Synthetic oligonucleotide
auaccauuggcgccugcuu

SEQ ID NO: 3662 - RNA, 19 nt, Artificial Sequence
  Description of Artificial Sequence: Synthetic oligonucleotide
gauaccauuggcgccugcu

SEQ ID NO: 3663 - RNA, 19 nt, Artificial Sequence
  Description of Artificial Sequence: Synthetic oligonucleotide
agauaccauuggcgccugc

SEQ ID NO: 3664 - RNA, 19 nt, Artificial Sequence
  Description of Artificial Sequence: Synthetic oligonucleotide
cagauaccauuggcgccug

SEQ ID NO: 3665 - RNA, 19 nt, Artificial Sequence
  Description of Artificial Sequence: Synthetic oligonucleotide
ccagauaccauuggcgccu

SEQ ID NO: 3666 - RNA, 19 nt, Artificial Sequence
  Description of Artificial Sequence: Synthetic oligonucleotide
cccagauaccauuggcgcc

SEQ ID NO: 3667 - RNA, 19 nt, Artificial Sequence
  Description of Artificial Sequence: Synthetic oligonucleotide
gcccagauaccauuggcgc

SEQ ID NO: 3668 - RNA, 19 nt, Artificial Sequence
  Description of Artificial Sequence: Synthetic oligonucleotide
cgcccagauaccauuggcg

SEQ ID NO: 3669 - RNA, 19 nt, Artificial Sequence
  Description of Artificial Sequence: Synthetic oligonucleotide
ccgcccagauaccauuggc

SEQ ID NO: 3670 - RNA, 19 nt, Artificial Sequence
  Description of Artificial Sequence: Synthetic oligonucleotide
uccgcccagauaccauugg

SEQ ID NO: 3671 - RNA, 19 nt, Artificial Sequence
  Description of Artificial Sequence: Synthetic oligonucleotide
cuccgcccagauaccauug

SEQ ID NO: 3672 - RNA, 19 nt, Artificial Sequence
  Description of Artificial Sequence: Synthetic oligonucleotide
gcuccgcccagauaccauu

SEQ ID NO: 3673 - RNA, 19 nt, Artificial Sequence
  Description of Artificial Sequence: Synthetic oligonucleotide
agcuccgcccagauaccau

SEQ ID NO: 3674 - RNA, 19 nt, Artificial Sequence
  Description of Artificial Sequence: Synthetic oligonucleotide
gagcuccgcccagauacca

SEQ ID NO: 3675 - RNA, 19 nt, Artificial Sequence
  Description of Artificial Sequence: Synthetic oligonucleotide
ugagcuccgcccagauacc

SEQ ID NO: 3676 - RNA, 19 nt, Artificial Sequence
  Description of Artificial Sequence: Synthetic oligonucleotide
gugagcuccgcccagauac

SEQ ID NO: 3677 - RNA, 19 nt, Artificial Sequence
  Description of Artificial Sequence: Synthetic oligonucleotide
ugugagcuccgcccagaua

SEQ ID NO: 3678 - RNA, 19 nt, Artificial Sequence
  Description of Artificial Sequence: Synthetic oligonucleotide
cugugagcuccgcccagau

SEQ ID NO: 3679 - RNA, 19 nt, Artificial Sequence
  Description of Artificial Sequence: Synthetic oligonucleotide
ucugugagcuccgcccaga

SEQ ID NO: 3680 - RNA, 19 nt, Artificial Sequence
  Description of Artificial Sequence: Synthetic oligonucleotide
cucugugagcuccgcccag

SEQ ID NO: 3681 - RNA, 19 nt, Artificial Sequence
  Description of Artificial Sequence: Synthetic oligonucleotide
acucugugagcuccgccca

SEQ ID NO: 3682 - RNA, 19 nt, Artificial Sequence
  Description of Artificial Sequence: Synthetic oligonucleotide
aacucugugagcuccgccc

SEQ ID NO: 3683 - RNA, 19 nt, Artificial Sequence
  Description of Artificial Sequence: Synthetic oligonucleotide
gaacucugugagcuccgcc

SEQ ID NO: 3684 - RNA, 19 nt, Artificial Sequence
  Description of Artificial Sequence: Synthetic oligonucleotide
agaacucugugagcuccgc

SEQ ID NO: 3685 - RNA, 19 nt, Artificial Sequence
  Description of Artificial Sequence: Synthetic oligonucleotide
aagaacucugugagcuccg

SEQ ID NO: 3686 - RNA, 19 nt, Artificial Sequence
  Description of Artificial Sequence: Synthetic oligonucleotide
caagaacucugugagcucc

SEQ ID NO: 3687 - RNA, 19 nt, Artificial Sequence
  Description of Artificial Sequence: Synthetic oligonucleotide
ccaagaacucugugagcuc

SEQ ID NO: 3688 - RNA, 19 nt, Artificial Sequence
  Description of Artificial Sequence: Synthetic oligonucleotide
uccaagaacucugugagcu

SEQ ID NO: 3689 - RNA, 19 nt, Artificial Sequence
  Description of Artificial Sequence: Synthetic oligonucleotide
uuccaagaacucugugagc

SEQ ID NO: 3690 - RNA, 19 nt, Artificial Sequence
  Description of Artificial Sequence: Synthetic oligonucleotide
auuccaagaacucugugag

SEQ ID NO: 3691 - RNA, 19 nt, Artificial Sequence
  Description of Artificial Sequence: Synthetic oligonucleotide
uauuccaagaacucuguga

SEQ ID NO: 3692 - RNA, 19 nt, Artificial Sequence
  Description of Artificial Sequence: Synthetic oligonucleotide
uuauuccaagaacucugug

SEQ ID NO: 3693 - RNA, 19 nt, Artificial Sequence
  Description of Artificial Sequence: Synthetic oligonucleotide
uuuauuccaagaacucugu

SEQ ID NO: 3694 - RNA, 19 nt, Artificial Sequence
  Description of Artificial Sequence: Synthetic oligonucleotide
uuuuauuccaagaacucug

SEQ ID NO: 3695 - RNA, 19 nt, Artificial Sequence
  Description of Artificial Sequence: Synthetic oligonucleotide
cuuuuauuccaagaacucu

SEQ ID NO: 3696 - RNA, 19 nt, Artificial Sequence
  Description of Artificial Sequence: Synthetic oligonucleotide
gcuuuuauuccaagaacuc

SEQ ID NO: 3697 - RNA, 19 nt, Artificial Sequence
  Description of Artificial Sequence: Synthetic oligonucleotide
ugcuuuuauuccaagaacu

SEQ ID NO: 3698 - RNA, 19 nt, Artificial Sequence
  Description of Artificial Sequence: Synthetic oligonucleotide
uugcuuuuauuccaagaac

SEQ ID NO: 3699 - RNA, 19 nt, Artificial Sequence
  Description of Artificial Sequence: Synthetic oligonucleotide
guugcuuuuauuccaagaa

SEQ ID NO: 3700 - RNA, 19 nt, Artificial Sequence
  Description of Artificial Sequence: Synthetic oligonucleotide
gguugcuuuuauuccaaga

SEQ ID NO: 3701 - RNA, 19 nt, Artificial Sequence
  Description of Artificial Sequence: Synthetic oligonucleotide
agguugcuuuuauuccaag

SEQ ID NO: 3702 - RNA, 19 nt, Artificial Sequence
  Description of Artificial Sequence: Synthetic oligonucleotide
gagguugcuuuuauuccaa

SEQ ID NO: 3703 - RNA, 19 nt, Artificial Sequence
  Description of Artificial Sequence: Synthetic oligonucleotide
ugagguugcuuuuauucca

SEQ ID NO: 3704 - RNA, 19 nt, Artificial Sequence
  Description of Artificial Sequence: Synthetic oligonucleotide
cugagguugcuuuuauucc

SEQ ID NO: 3705 - RNA, 19 nt, Artificial Sequence
  Description of Artificial Sequence: Synthetic oligonucleotide
ucugagguugcuuuuauuc

SEQ ID NO: 3706 - RNA, 19 nt, Artificial Sequence
  Description of Artificial Sequence: Synthetic oligonucleotide
uucugagguugcuuuuauu

SEQ ID NO: 3707 - RNA, 19 nt, Artificial Sequence
  Description of Artificial Sequence: Synthetic oligonucleotide
guucugagguugcuuuuau

SEQ ID NO: 3708 - RNA, 19 nt, Artificial Sequence
  Description of Artificial Sequence: Synthetic oligonucleotide
uguucugagguugcuuuua

SEQ ID NO: 3709 - DNA, 20 bp, Artificial Sequence
  Description of Artificial Sequence: Synthetic oligonucleotide
aagtgttctgaggttgcttt

SEQ ID NO: 3710 - DNA, 20 bp, Artificial Sequence
  Description of Artificial Sequence: Synthetic oligonucleotide
agtgttctgaggttgctttt

SEQ ID NO: 3711 - DNA, 20 bp, Artificial Sequence
  Description of Artificial Sequence: Synthetic oligonucleotide
gtgttctgaggttgctttta

SEQ ID NO: 3712 - DNA, 20 bp, Artificial Sequence
  Description of Artificial Sequence: Synthetic oligonucleotide
tgttctgaggttgcttttat

SEQ ID NO: 3713 - DNA, 20 bp, Artificial Sequence
  Description of Artificial Sequence: Synthetic oligonucleotide
gttctgaggttgcttttatt

SEQ ID NO: 3714 - DNA, 20 bp, Artificial Sequence
  Description of Artificial Sequence: Synthetic oligonucleotide
ttctgaggttgcttttattc

SEQ ID NO: 3715 - DNA, 20 bp, Artificial Sequence
  Description of Artificial Sequence: Synthetic oligonucleotide
tctgaggttgcttttattcc

SEQ ID NO: 3716 - DNA, 20 bp, Artificial Sequence
  Description of Artificial Sequence: Synthetic oligonucleotide
ctgaggttgcttttattcca

SEQ ID NO: 3717 - DNA, 20 bp, Artificial Sequence
  Description of Artificial Sequence: Synthetic oligonucleotide
tgaggttgcttttattccaa

SEQ ID NO: 3718 - DNA, 20 bp, Artificial Sequence
  Description of Artificial Sequence: Synthetic oligonucleotide
gaggttgcttttattccaag

SEQ ID NO: 3719 - DNA, 20 bp, Artificial Sequence
  Description of Artificial Sequence: Synthetic oligonucleotide
aggttgcttttattccaaga

SEQ ID NO: 3720 - DNA, 20 bp, Artificial Sequence
  Description of Artificial Sequence: Synthetic oligonucleotide
ggttgcttttattccaagaa

SEQ ID NO: 3721 - DNA, 20 bp, Artificial Sequence
  Description of Artificial Sequence: Synthetic oligonucleotide
gttgcttttattccaagaac

SEQ ID NO: 3722 - DNA, 20 bp, Artificial Sequence
  Description of Artificial Sequence: Synthetic oligonucleotide
ttgcttttattccaagaact

SEQ ID NO: 3723 - DNA, 20 bp, Artificial Sequence
  Description of Artificial Sequence: Synthetic oligonucleotide
tgcttttattccaagaactc

SEQ ID NO: 3724 - DNA, 20 bp, Artificial Sequence
  Description of Artificial Sequence: Synthetic oligonucleotide
gcttttattccaagaactct

SEQ ID NO: 3725 - DNA, 20 bp, Artificial Sequence
  Description of Artificial Sequence: Synthetic oligonucleotide
cttttattccaagaactctg

SEQ ID NO: 3726 - DNA, 20 bp, Artificial Sequence
  Description of Artificial Sequence: Synthetic oligonucleotide
ttttattccaagaactctgt

SEQ ID NO: 3727 - DNA, 20 bp, Artificial Sequence
  Description of Artificial Sequence: Synthetic oligonucleotide
tttattccaagaactctgtg

SEQ ID NO: 3728 - DNA, 20 bp, Artificial Sequence
  Description of Artificial Sequence: Synthetic oligonucleotide
ttattccaagaactctgtga

SEQ ID NO: 3729 - DNA, 20 bp, Artificial Sequence
  Description of Artificial Sequence: Synthetic oligonucleotide
tattccaagaactctgtgag

SEQ ID NO: 3730 - DNA, 20 bp, Artificial Sequence
  Description of Artificial Sequence: Synthetic oligonucleotide
attccaagaactctgtgagc

SEQ ID NO: 3731 - DNA, 20 bp, Artificial Sequence
  Description of Artificial Sequence: Synthetic oligonucleotide
ttccaagaactctgtgagct

SEQ ID NO: 3732 - DNA, 20 bp, Artificial Sequence
  Description of Artificial Sequence: Synthetic oligonucleotide
tccaagaactctgtgagctc

SEQ ID NO: 3733 - DNA, 20 bp, Artificial Sequence
  Description of Artificial Sequence: Synthetic oligonucleotide
ccaagaactctgtgagctcc

SEQ ID NO: 3734 - DNA, 20 bp, Artificial Sequence
  Description of Artificial Sequence: Synthetic oligonucleotide
caagaactctgtgagctccg

SEQ ID NO: 3735 - DNA, 20 bp, Artificial Sequence
  Description of Artificial Sequence: Synthetic oligonucleotide
aagaactctgtgagctccgc

SEQ ID NO: 3736 - DNA, 20 bp, Artificial Sequence
  Description of Artificial Sequence: Synthetic oligonucleotide
agaactctgtgagctccgcc

SEQ ID NO: 3737 - DNA, 20 bp, Artificial Sequence
  Description of Artificial Sequence: Synthetic oligonucleotide
gaactctgtgagctccgccc

SEQ ID NO: 3738 - DNA, 20 bp, Artificial Sequence
  Description of Artificial Sequence: Synthetic oligonucleotide
aactctgtgagctccgccca

SEQ ID NO: 3739 - DNA, 20 bp, Artificial Sequence
  Description of Artificial Sequence: Synthetic oligonucleotide
actctgtgagctccgcccag

SEQ ID NO: 3740 - DNA, 20 bp, Artificial Sequence
  Description of Artificial Sequence: Synthetic oligonucleotide
ctctgtgagctccgcccaga

SEQ ID NO: 3741 - DNA, 20 bp, Artificial Sequence
  Description of Artificial Sequence: Synthetic oligonucleotide
tctgtgagctccgcccagat

SEQ ID NO: 3742 - DNA, 20 bp, Artificial Sequence
  Description of Artificial Sequence: Synthetic oligonucleotide
ctgtgagctccgcccagata

SEQ ID NO: 3743 - DNA, 20 bp, Artificial Sequence
  Description of Artificial Sequence: Synthetic oligonucleotide
tgtgagctccgcccagatac

SEQ ID NO: 3744 - DNA, 20 bp, Artificial Sequence
  Description of Artificial Sequence: Synthetic oligonucleotide
gtgagctccgcccagatacc

SEQ ID NO: 3745 - DNA, 20 bp, Artificial Sequence
  Description of Artificial Sequence: Synthetic oligonucleotide
tgagctccgcccagatacca

SEQ ID NO: 3746 - DNA, 20 bp, Artificial Sequence
  Description of Artificial Sequence: Synthetic oligonucleotide
gagctccgcccagataccat

SEQ ID NO: 3747 - DNA, 20 bp, Artificial Sequence
  Description of Artificial Sequence: Synthetic oligonucleotide
agctccgcccagataccatt

SEQ ID NO: 3748 - DNA, 20 bp, Artificial Sequence
  Description of Artificial Sequence: Synthetic oligonucleotide
gctccgcccagataccattg

SEQ ID NO: 3749 - DNA, 20 bp, Artificial Sequence
  Description of Artificial Sequence: Synthetic oligonucleotide
ctccgcccagataccattgg

SEQ ID NO: 3750 - DNA, 20 bp, Artificial Sequence
  Description of Artificial Sequence: Synthetic oligonucleotide
tccgcccagataccattggc

SEQ ID NO: 3751 - DNA, 20 bp, Artificial Sequence
  Description of Artificial Sequence: Synthetic oligonucleotide
ccgcccagataccattggcg

SEQ ID NO: 3752 - DNA, 20 bp, Artificial Sequence
  Description of Artificial Sequence: Synthetic oligonucleotide
cgcccagataccattggcgc

SEQ ID NO: 3753 - DNA, 20 bp, Artificial Sequence
  Description of Artificial Sequence: Synthetic oligonucleotide
gcccagataccattggcgcc

SEQ ID NO: 3754 - DNA, 20 bp, Artificial Sequence
  Description of Artificial Sequence: Synthetic oligonucleotide
cccagataccattggcgcct

SEQ ID NO: 3755 - DNA, 20 bp, Artificial Sequence
  Description of Artificial Sequence: Synthetic oligonucleotide
ccagataccattggcgcctg

SEQ ID NO: 3756 - DNA, 20 bp, Artificial Sequence
  Description of Artificial Sequence: Synthetic oligonucleotide
cagataccattggcgcctgc

SEQ ID NO: 3757 - DNA, 20 bp, Artificial Sequence
  Description of Artificial Sequence: Synthetic oligonucleotide
agataccattggcgcctgct

SEQ ID NO: 3758 - DNA, 20 bp, Artificial Sequence
  Description of Artificial Sequence: Synthetic oligonucleotide
gataccattggcgcctgctt

SEQ ID NO: 3759 - DNA, 20 bp, Artificial Sequence
  Description of Artificial Sequence: Synthetic oligonucleotide
ataccattggcgcctgcttg

SEQ ID NO: 3760 - DNA, 20 bp, Artificial Sequence
  Description of Artificial Sequence: Synthetic oligonucleotide
taccattggcgcctgcttgt

SEQ ID NO: 3761 - DNA, 20 bp, Artificial Sequence
  Description of Artificial Sequence: Synthetic oligonucleotide
accattggcgcctgcttgtg

SEQ ID NO: 3762 - DNA, 20 bp, Artificial Sequence
  Description of Artificial Sequence: Synthetic oligonucleotide
ccattggcgcctgcttgtgt

SEQ ID NO: 3763 - DNA, 20 bp, Artificial Sequence
  Description of Artificial Sequence: Synthetic oligonucleotide
cattggcgcctgcttgtgtc

SEQ ID NO: 3764 - DNA, 20 bp, Artificial Sequence
  Description of Artificial Sequence: Synthetic oligonucleotide
attggcgcctgcttgtgtcc

SEQ ID NO: 3765 - DNA, 20 bp, Artificial Sequence
  Description of Artificial Sequence: Synthetic oligonucleotide
ttggcgcctgcttgtgtccc

SEQ ID NO: 3766 - DNA, 20 bp, Artificial Sequence
  Description of Artificial Sequence: Synthetic oligonucleotide
tggcgcctgcttgtgtcccc

SEQ ID NO: 3767 - DNA, 20 bp, Artificial Sequence
  Description of Artificial Sequence: Synthetic oligonucleotide
ggcgcctgcttgtgtcccca

SEQ ID NO: 3768 - DNA, 20 bp, Artificial Sequence
  Description of Artificial Sequence: Synthetic oligonucleotide
gcgcctgcttgtgtccccag

SEQ ID NO: 3769 - DNA, 20 bp, Artificial Sequence
  Description of Artificial Sequence: Synthetic oligonucleotide
cgcctgcttgtgtccccagg

SEQ ID NO: 3770 - DNA, 20 bp, Artificial Sequence
  Description of Artificial Sequence: Synthetic oligonucleotide
gcctgcttgtgtccccaggg

SEQ ID NO: 3771 - DNA, 20 bp, Artificial Sequence
  Description of Artificial Sequence: Synthetic oligonucleotide
cctgcttgtgtccccagggg

SEQ ID NO: 3772 - DNA, 20 bp, Artificial Sequence
  Description of Artificial Sequence: Synthetic oligonucleotide
ctgcttgtgtccccagggga

SEQ ID NO: 3773 - DNA, 20 bp, Artificial Sequence
  Description of Artificial Sequence: Synthetic oligonucleotide
tgcttgtgtccccaggggac

SEQ ID NO: 3774 - DNA, 20 bp, Artificial Sequence
  Description of Artificial Sequence: Synthetic oligonucleotide
gcttgtgtccccaggggacc

SEQ ID NO: 3775 - DNA, 20 bp, Artificial Sequence
  Description of Artificial Sequence: Synthetic oligonucleotide
cttgtgtccccaggggacct

SEQ ID NO: 3776 - DNA, 20 bp, Artificial Sequence
  Description of Artificial Sequence: Synthetic oligonucleotide
ttgtgtccccaggggaccta

SEQ ID NO: 3777 - DNA, 20 bp, Artificial Sequence
  Description of Artificial Sequence: Synthetic oligonucleotide
tgtgtccccaggggacctac

SEQ ID NO: 3778 - DNA, 20 bp, Artificial Sequence
  Description of Artificial Sequence: Synthetic oligonucleotide
gtgtccccaggggacctaca

SEQ ID NO: 3779 - DNA, 20 bp, Artificial Sequence
  Description of Artificial Sequence: Synthetic oligonucleotide
tgtccccaggggacctacac

SEQ ID NO: 3780 - DNA, 20 bp, Artificial Sequence
  Description of Artificial Sequence: Synthetic oligonucleotide
gtccccaggggacctacaca

SEQ ID NO: 3781 - DNA, 20 bp, Artificial Sequence
  Description of Artificial Sequence: Synthetic oligonucleotide
tccccaggggacctacacac

SEQ ID NO: 3782 - DNA, 20 bp, Artificial Sequence
  Description of Artificial Sequence: Synthetic oligonucleotide
ccccaggggacctacacaca

SEQ ID NO: 3783 - DNA, 20 bp, Artificial Sequence
  Description of Artificial Sequence: Synthetic oligonucleotide
cccaggggacctacacacaa

SEQ ID NO: 3784 - DNA, 20 bp, Artificial Sequence
  Description of Artificial Sequence: Synthetic oligonucleotide
ccaggggacctacacacaac

SEQ ID NO: 3785 - DNA, 20 bp, Artificial Sequence
  Description of Artificial Sequence: Synthetic oligonucleotide
caggggacctacacacaaca

SEQ ID NO: 3786 - DNA, 20 bp, Artificial Sequence
  Description of Artificial Sequence: Synthetic oligonucleotide
aggggacctacacacaacag

SEQ ID NO: 3787 - DNA, 20 bp, Artificial Sequence
  Description of Artificial Sequence: Synthetic oligonucleotide
ggggacctacacacaacagc

SEQ ID NO: 3788 - DNA, 20 bp, Artificial Sequence
  Description of Artificial Sequence: Synthetic oligonucleotide
gggacctacacacaacagca

SEQ ID NO: 3789 - DNA, 20 bp, Artificial Sequence
  Description of Artificial Sequence: Synthetic oligonucleotide
ggacctacacacaacagcac

SEQ ID NO: 3790 - DNA, 20 bp, Artificial Sequence
  Description of Artificial Sequence: Synthetic oligonucleotide
gacctacacacaacagcacc

SEQ ID NO: 3791 - DNA, 20 bp, Artificial Sequence
  Description of Artificial Sequence: Synthetic oligonucleotide
acctacacacaacagcacca

SEQ ID NO: 3792 - DNA, 20 bp, Artificial Sequence
  Description of Artificial Sequence: Synthetic oligonucleotide
cctacacacaacagcaccag

SEQ ID NO: 3793 - DNA, 20 bp, Artificial Sequence
  Description of Artificial Sequence: Synthetic oligonucleotide
ctacacacaacagcaccagc

SEQ ID NO: 3794 - DNA, 20 bp, Artificial Sequence
  Description of Artificial Sequence: Synthetic oligonucleotide
tacacacaacagcaccagca

SEQ ID NO: 3795 - DNA, 20 bp, Artificial Sequence
  Description of Artificial Sequence: Synthetic oligonucleotide
acacacaacagcaccagcac

SEQ ID NO: 3796 - DNA, 20 bp, Artificial Sequence
  Description of Artificial Sequence: Synthetic oligonucleotide
cacacaacagcaccagcacc

SEQ ID NO: 3797 - DNA, 20 bp, Artificial Sequence
  Description of Artificial Sequence: Synthetic oligonucleotide
acacaacagcaccagcacca

SEQ ID NO: 3798 - DNA, 20 bp, Artificial Sequence
  Description of Artificial Sequence: Synthetic oligonucleotide
cacaacagcaccagcaccat

SEQ ID NO: 3799 - DNA, 20 bp, Artificial Sequence
  Description of Artificial Sequence: Synthetic oligonucleotide
acaacagcaccagcaccatg

SEQ ID NO: 3800 - DNA, 20 bp, Artificial Sequence
  Description of Artificial Sequence: Synthetic oligonucleotide
caacagcaccagcaccatga

SEQ ID NO: 3801 - DNA, 20 bp, Artificial Sequence
  Description of Artificial Sequence: Synthetic oligonucleotide
aacagcaccagcaccatgag

SEQ ID NO: 3802 - DNA, 20 bp, Artificial Sequence
  Description of Artificial Sequence: Synthetic oligonucleotide
acagcaccagcaccatgagg

SEQ ID NO: 3803 - DNA, 20 bp, Artificial Sequence
  Description of Artificial Sequence: Synthetic oligonucleotide
cagcaccagcaccatgaggg

SEQ ID NO: 3804 - DNA, 20 bp, Artificial Sequence
  Description of Artificial Sequence: Synthetic oligonucleotide
agcaccagcaccatgagggc

SEQ ID NO: 3805 - DNA, 20 bp, Artificial Sequence
  Description of Artificial Sequence: Synthetic oligonucleotide
gcaccagcaccatgagggcg

SEQ ID NO: 3806 - DNA, 20 bp, Artificial Sequence
  Description of Artificial Sequence: Synthetic oligonucleotide
caccagcaccatgagggcgc

SEQ ID NO: 3807 - DNA, 20 bp, Artificial Sequence
  Description of Artificial Sequence: Synthetic oligonucleotide
accagcaccatgagggcgct

SEQ ID NO: 3808 - DNA, 20 bp, Artificial Sequence
  Description of Artificial Sequence: Synthetic oligonucleotide
ccagcaccatgagggcgctc

SEQ ID NO: 3809 - DNA, 20 bp, Artificial Sequence
  Description of Artificial Sequence: Synthetic oligonucleotide
cagcaccatgagggcgctct

SEQ ID NO: 3810 - DNA, 20 bp, Artificial Sequence
  Description of Artificial Sequence: Synthetic oligonucleotide
agcaccatgagggcgctctc

SEQ ID NO: 3811 - DNA, 20 bp, Artificial Sequence
  Description of Artificial Sequence: Synthetic oligonucleotide
gcaccatgagggcgctctcg

SEQ ID NO: 3812 - DNA, 20 bp, Artificial Sequence
  Description of Artificial Sequence: Synthetic oligonucleotide
caccatgagggcgctctcga

SEQ ID NO: 3813 - DNA, 20 bp, Artificial Sequence
  Description of Artificial Sequence: Synthetic oligonucleotide
accatgagggcgctctcgac

SEQ ID NO: 3814 - DNA, 20 bp, Artificial Sequence
  Description of Artificial Sequence: Synthetic oligonucleotide
ccatgagggcgctctcgacc

SEQ ID NO: 3815 - DNA, 20 bp, Artificial Sequence
  Description of Artificial Sequence: Synthetic oligonucleotide
catgagggcgctctcgaccc

SEQ ID NO: 3816 - DNA, 20 bp, Artificial Sequence
  Description of Artificial Sequence: Synthetic oligonucleotide
atgagggcgctctcgaccca

SEQ ID NO: 3817 - DNA, 20 bp, Artificial Sequence
  Description of Artificial Sequence: Synthetic oligonucleotide
tgagggcgctctcgacccac

SEQ ID NO: 3818 - DNA, 20 bp, Artificial Sequence
  Description of Artificial Sequence: Synthetic oligonucleotide
gagggcgctctcgacccaca

SEQ ID NO: 3819 - DNA, 20 bp, Artificial Sequence
  Description of Artificial Sequence: Synthetic oligonucleotide
agggcgctctcgacccacac

SEQ ID NO: 3820 - DNA, 20 bp, Artificial Sequence
  Description of Artificial Sequence: Synthetic oligonucleotide
gggcgctctcgacccacaca

SEQ ID NO: 3821 - DNA, 20 bp, Artificial Sequence
  Description of Artificial Sequence: Synthetic oligonucleotide
ggcgctctcgacccacacaa

SEQ ID NO: 3822 - DNA, 20 bp, Artificial Sequence
  Description of Artificial Sequence: Synthetic oligonucleotide
gcgctctcgacccacacaag

SEQ ID NO: 3823 - DNA, 20 bp, Artificial Sequence
  Description of Artificial Sequence: Synthetic oligonucleotide
cgctctcgacccacacaagc

SEQ ID NO: 3824 - DNA, 20 bp, Artificial Sequence
  Description of Artificial Sequence: Synthetic oligonucleotide
gctctcgacccacacaagcc

SEQ ID NO: 3825 - DNA, 20 bp, Artificial Sequence
  Description of Artificial Sequence: Synthetic oligonucleotide
ctctcgacccacacaagccc

SEQ ID NO: 3826 - DNA, 20 bp, Artificial Sequence
  Description of Artificial Sequence: Synthetic oligonucleotide
tctcgacccacacaagccct

SEQ ID NO: 3827 - DNA, 20 bp, Artificial Sequence
  Description of Artificial Sequence: Synthetic oligonucleotide
ctcgacccacacaagccctg

SEQ ID NO: 3828 - DNA, 20 bp, Artificial Sequence
  Description of Artificial Sequence: Synthetic oligonucleotide
tcgacccacacaagccctgg

SEQ ID NO: 3829 - DNA, 20 bp, Artificial Sequence
  Description of Artificial Sequence: Synthetic oligonucleotide
cgacccacacaagccctggt

SEQ ID NO: 3830 - DNA, 20 bp, Artificial Sequence
  Description of Artificial Sequence: Synthetic oligonucleotide
gacccacacaagccctggtc

SEQ ID NO: 3831 - DNA, 20 bp, Artificial Sequence
  Description of Artificial Sequence: Synthetic oligonucleotide
acccacacaagccctggtcc

SEQ ID NO: 3832 - DNA, 20 bp, Artificial Sequence
  Description of Artificial Sequence: Synthetic oligonucleotide
cccacacaagccctggtccc

SEQ ID NO: 3833 - DNA, 20 bp, Artificial Sequence
  Description of Artificial Sequence: Synthetic oligonucleotide
ccacacaagccctggtcccc

SEQ ID NO: 3834 - DNA, 20 bp, Artificial Sequence
  Description of Artificial Sequence: Synthetic oligonucleotide
cacacaagccctggtccccg

SEQ ID NO: 3835 - DNA, 20 bp, Artificial Sequence
  Description of Artificial Sequence: Synthetic oligonucleotide
acacaagccctggtccccgt

SEQ ID NO: 3836 - DNA, 20 bp, Artificial Sequence
  Description of Artificial Sequence: Synthetic oligonucleotide
cacaagccctggtccccgtc

SEQ ID NO: 3837 - DNA, 20 bp, Artificial Sequence
  Description of Artificial Sequence: Synthetic oligonucleotide
acaagccctggtccccgtca

SEQ ID NO: 3838 - DNA, 20 bp, Artificial Sequence
  Description of Artificial Sequence: Synthetic oligonucleotide
caagccctggtccccgtcag

SEQ ID NO: 3839 - DNA, 20 bp, Artificial Sequence
  Description of Artificial Sequence: Synthetic oligonucleotide
aagccctggtccccgtcagt

SEQ ID NO: 3840 - DNA, 20 bp, Artificial Sequence
  Description of Artificial Sequence: Synthetic oligonucleotide
agccctggtccccgtcagtc

SEQ ID NO: 3841 - DNA, 20 bp, Artificial Sequence
  Description of Artificial Sequence: Synthetic oligonucleotide
gccctggtccccgtcagtca

SEQ ID NO: 3842 - DNA, 20 bp, Artificial Sequence
  Description of Artificial Sequence: Synthetic oligonucleotide
ccctggtccccgtcagtcaa

SEQ ID NO: 3843 - DNA, 20 bp, Artificial Sequence
  Description of Artificial Sequence: Synthetic oligonucleotide
cctggtccccgtcagtcaat

SEQ ID NO: 3844 - DNA, 20 bp, Artificial Sequence
  Description of Artificial Sequence: Synthetic oligonucleotide
ctggtccccgtcagtcaatg

SEQ ID NO: 3845 - DNA, 20 bp, Artificial Sequence
  Description of Artificial Sequence: Synthetic oligonucleotide
tggtccccgtcagtcaatgt

SEQ ID NO: 3846 - DNA, 20 bp, Artificial Sequence
  Description of Artificial Sequence: Synthetic oligonucleotide
ggtccccgtcagtcaatgtg

SEQ ID NO: 3847 - DNA, 20 bp, Artificial Sequence
  Description of Artificial Sequence: Synthetic oligonucleotide
gtccccgtcagtcaatgtga

SEQ ID NO: 3848 - DNA, 20 bp, Artificial Sequence
  Description of Artificial Sequence: Synthetic oligonucleotide
tccccgtcagtcaatgtgac

SEQ ID NO: 3849 - DNA, 20 bp, Artificial Sequence
  Description of Artificial Sequence: Synthetic oligonucleotide
ccccgtcagtcaatgtgact

SEQ ID NO: 3850 - DNA, 20 bp, Artificial Sequence
  Description of Artificial Sequence: Synthetic oligonucleotide
cccgtcagtcaatgtgactg

SEQ ID NO: 3851 - DNA, 20 bp, Artificial Sequence
  Description of Artificial Sequence: Synthetic oligonucleotide
ccgtcagtcaatgtgactga

SEQ ID NO: 3852 - DNA, 20 bp, Artificial Sequence
  Description of Artificial Sequence: Synthetic oligonucleotide
cgtcagtcaatgtgactgag

SEQ ID NO: 3853 - DNA, 20 bp, Artificial Sequence
  Description of Artificial Sequence: Synthetic oligonucleotide
gtcagtcaatgtgactgagt

SEQ ID NO: 3854 - DNA, 20 bp, Artificial Sequence
  Description of Artificial Sequence: Synthetic oligonucleotide
tcagtcaatgtgactgagtc

SEQ ID NO: 3855 - DNA, 20 bp, Artificial Sequence
  Description of Artificial Sequence: Synthetic oligonucleotide
cagtcaatgtgactgagtcc

SEQ ID NO: 3856 - DNA, 20 bp, Artificial Sequence
  Description of Artificial Sequence: Synthetic oligonucleotide
agtcaatgtgactgagtccg

SEQ ID NO: 3857 - DNA, 20 bp, Artificial Sequence
  Description of Artificial Sequence: Synthetic oligonucleotide
gtcaatgtgactgagtccgc

SEQ ID NO: 3858 - DNA, 20 bp, Artificial Sequence
  Description of Artificial Sequence: Synthetic oligonucleotide
tcaatgtgactgagtccgcc

SEQ ID NO: 3859 - DNA, 20 bp, Artificial Sequence
  Description of Artificial Sequence: Synthetic oligonucleotide
caatgtgactgagtccgcca

SEQ ID NO: 3860 - DNA, 20 bp, Artificial Sequence
  Description of Artificial Sequence: Synthetic oligonucleotide
aatgtgactgagtccgccat

SEQ ID NO: 3861 - DNA, 20 bp, Artificial Sequence
  Description of Artificial Sequence: Synthetic oligonucleotide
atgtgactgagtccgccatt

SEQ ID NO: 3862 - DNA, 20 bp, Artificial Sequence
  Description of Artificial Sequence: Synthetic oligonucleotide
tgtgactgagtccgccattg

SEQ ID NO: 3863 - DNA, 20 bp, Artificial Sequence
  Description of Artificial Sequence: Synthetic oligonucleotide
gtgactgagtccgccattga

SEQ ID NO: 3864 - DNA, 20 bp, Artificial Sequence
  Description of Artificial Sequence: Synthetic oligonucleotide
tgactgagtccgccattgag

SEQ ID NO: 3865 - DNA, 20 bp, Artificial Sequence
  Description of Artificial Sequence: Synthetic oligonucleotide
gactgagtccgccattgagg

SEQ ID NO: 3866 - DNA, 20 bp, Artificial Sequence
  Description of Artificial Sequence: Synthetic oligonucleotide
actgagtccgccattgaggc

SEQ ID NO: 3867 - DNA, 20 bp, Artificial Sequence
  Description of Artificial Sequence: Synthetic oligonucleotide
ctgagtccgccattgaggcc

SEQ ID NO: 3868 - DNA, 20 bp, Artificial Sequence
  Description of Artificial Sequence: Synthetic oligonucleotide
tgagtccgccattgaggcca

SEQ ID NO: 3869 - DNA, 20 bp, Artificial Sequence
  Description of Artificial Sequence: Synthetic oligonucleotide
gagtccgccattgaggccag

SEQ ID NO: 3870 - DNA, 20 bp, Artificial Sequence
  Description of Artificial Sequence: Synthetic oligonucleotide
agtccgccattgaggccagt

SEQ ID NO: 3871 - DNA, 20 bp, Artificial Sequence
  Description of Artificial Sequence: Synthetic oligonucleotide
gtccgccattgaggccagtc

SEQ ID NO: 3872 - DNA, 20 bp, Artificial Sequence
  Description of Artificial Sequence: Synthetic oligonucleotide
tccgccattgaggccagtct

SEQ ID NO: 3873 - DNA, 20 bp, Artificial Sequence
  Description of Artificial Sequence: Synthetic oligonucleotide
ccgccattgaggccagtctg

SEQ ID NO: 3874 - DNA, 20 bp, Artificial Sequence
  Description of Artificial Sequence: Synthetic oligonucleotide
cgccattgaggccagtctgg

SEQ ID NO: 3875 - DNA, 20 bp, Artificial Sequence
  Description of Artificial Sequence: Synthetic oligonucleotide
gccattgaggccagtctggc

SEQ ID NO: 3876 - DNA, 20 bp, Artificial Sequence
  Description of Artificial Sequence: Synthetic oligonucleotide
ccattgaggccagtctggct

SEQ ID NO: 3877 - DNA, 20 bp, Artificial Sequence
  Description of Artificial Sequence: Synthetic oligonucleotide
cattgaggccagtctggctg

SEQ ID NO: 3878 - DNA, 20 bp, Artificial Sequence
  Description of Artificial Sequence: Synthetic oligonucleotide
attgaggccagtctggctgg

SEQ ID NO: 3879 - DNA, 20 bp, Artificial Sequence
  Description of Artificial Sequence: Synthetic oligonucleotide
ttgaggccagtctggctggc

SEQ ID NO: 3880 - DNA, 20 bp, Artificial Sequence
  Description of Artificial Sequence: Synthetic oligonucleotide
tgaggccagtctggctggcc

SEQ ID NO: 3881 - DNA, 20 bp, Artificial Sequence
  Description of Artificial Sequence: Synthetic oligonucleotide
gaggccagtctggctggccc

SEQ ID NO: 3882 - DNA, 20 bp, Artificial Sequence
  Description of Artificial Sequence: Synthetic oligonucleotide
aggccagtctggctggcccc

SEQ ID NO: 3883 - DNA, 20 bp, Artificial Sequence
  Description of Artificial Sequence: Synthetic oligonucleotide
ggccagtctggctggcccca

SEQ ID NO: 3884 - DNA, 20 bp, Artificial Sequence
  Description of Artificial Sequence: Synthetic oligonucleotide
gccagtctggctggccccaa

SEQ ID NO: 3885 - DNA, 20 bp, Artificial Sequence
  Description of Artificial Sequence: Synthetic oligonucleotide
ccagtctggctggccccaag

SEQ ID NO: 3886 - DNA, 20 bp, Artificial Sequence
  Description of Artificial Sequence: Synthetic oligonucleotide
cagtctggctggccccaagt

SEQ ID NO: 3887 - DNA, 20 bp, Artificial Sequence
  Description of Artificial Sequence: Synthetic oligonucleotide
agtctggctggccccaagtg

SEQ ID NO: 3888 - DNA, 20 bp, Artificial Sequence
  Description of Artificial Sequence: Synthetic oligonucleotide
gtctggctggccccaagtgg

SEQ ID NO: 3889 - DNA, 20 bp, Artificial Sequence
  Description of Artificial Sequence: Synthetic oligonucleotide
tctggctggccccaagtggt

SEQ ID NO: 3890 - DNA, 20 bp, Artificial Sequence
  Description of Artificial Sequence: Synthetic oligonucleotide
ctggctggccccaagtggtc

SEQ ID NO: 3891 - DNA, 20 bp, Artificial Sequence
  Description of Artificial Sequence: Synthetic oligonucleotide
tggctggccccaagtggtcc

SEQ ID NO: 3892 - DNA, 20 bp, Artificial Sequence
  Description of Artificial Sequence: Synthetic oligonucleotide
ggctggccccaagtggtccc

SEQ ID NO: 3893 - DNA, 20 bp, Artificial Sequence
  Description of Artificial Sequence: Synthetic oligonucleotide
gctggccccaagtggtccct

SEQ ID NO: 3894 - DNA, 20 bp, Artificial Sequence
  Description of Artificial Sequence: Synthetic oligonucleotide
ctggccccaagtggtccctc

SEQ ID NO: 3895 - DNA, 20 bp, Artificial Sequence
  Description of Artificial Sequence: Synthetic oligonucleotide
tggccccaagtggtccctct

SEQ ID NO: 3896 - DNA, 20 bp, Artificial Sequence
  Description of Artificial Sequence: Synthetic oligonucleotide
ggccccaagtggtccctctg

SEQ ID NO: 3897 - DNA, 20 bp, Artificial Sequence
  Description of Artificial Sequence: Synthetic oligonucleotide
gccccaagtggtccctctga

SEQ ID NO: 3898 - DNA, 20 bp, Artificial Sequence
  Description of Artificial Sequence: Synthetic oligonucleotide
ccccaagtggtccctctgag

SEQ ID NO: 3899 - DNA, 20 bp, Artificial Sequence
  Description of Artificial Sequence: Synthetic oligonucleotide
cccaagtggtccctctgagt

SEQ ID NO: 3900 - DNA, 20 bp, Artificial Sequence
  Description of Artificial Sequence: Synthetic oligonucleotide
ccaagtggtccctctgagtc

SEQ ID NO: 3901 - DNA, 20 bp, Artificial Sequence
  Description of Artificial Sequence: Synthetic oligonucleotide
caagtggtccctctgagtcc

SEQ ID NO: 3902 - DNA, 20 bp, Artificial Sequence
  Description of Artificial Sequence: Synthetic oligonucleotide
aagtggtccctctgagtccc

SEQ ID NO: 3903 - DNA, 20 bp, Artificial Sequence
  Description of Artificial Sequence: Synthetic oligonucleotide
agtggtccctctgagtcccc

SEQ ID NO: 3904 - DNA, 20 bp, Artificial Sequence
  Description of Artificial Sequence: Synthetic oligonucleotide
gtggtccctctgagtcccca

SEQ ID NO: 3905 - DNA, 20 bp, Artificial Sequence
  Description of Artificial Sequence: Synthetic oligonucleotide
tggtccctctgagtccccaa

SEQ ID NO: 3906 - DNA, 20 bp, Artificial Sequence
  Description of Artificial Sequence: Synthetic oligonucleotide
ggtccctctgagtccccaac

SEQ ID NO: 3907 - DNA, 20 bp, Artificial Sequence
  Description of Artificial Sequence: Synthetic oligonucleotide
gtccctctgagtccccaact

SEQ ID NO: 3908 - DNA, 20 bp, Artificial Sequence
  Description of Artificial Sequence: Synthetic oligonucleotide
tccctctgagtccccaactc

SEQ ID NO: 3909 - DNA, 20 bp, Artificial Sequence
  Description of Artificial Sequence: Synthetic oligonucleotide
ccctctgagtccccaactcc

SEQ ID NO: 3910 - DNA, 20 bp, Artificial Sequence
  Description of Artificial Sequence: Synthetic oligonucleotide
cctctgagtccccaactccc

SEQ ID NO: 3911 - DNA, 20 bp, Artificial Sequence
  Description of Artificial Sequence: Synthetic oligonucleotide
ctctgagtccccaactccct

SEQ ID NO: 3912 - DNA, 20 bp, Artificial Sequence
  Description of Artificial Sequence: Synthetic oligonucleotide
tctgagtccccaactccctg

SEQ ID NO: 3913 - DNA, 20 bp, Artificial Sequence
  Description of Artificial Sequence: Synthetic oligonucleotide
ctgagtccccaactccctgg

SEQ ID NO: 3914 - DNA, 20 bp, Artificial Sequence
  Description of Artificial Sequence: Synthetic oligonucleotide
tgagtccccaactccctggc

SEQ ID NO: 3915 - DNA, 20 bp, Artificial Sequence
  Description of Artificial Sequence: Synthetic oligonucleotide
gagtccccaactccctggcc

SEQ ID NO: 3916 - DNA, 20 bp, Artificial Sequence
  Description of Artificial Sequence: Synthetic oligonucleotide
agtccccaactccctggcca

SEQ ID NO: 3917 - DNA, 20 bp, Artificial Sequence
  Description of Artificial Sequence: Synthetic oligonucleotide
gtccccaactccctggccag

SEQ ID NO: 3918 - DNA, 20 bp, Artificial Sequence
  Description of Artificial Sequence: Synthetic oligonucleotide
tccccaactccctggccagc

SEQ ID NO: 3919 - DNA, 20 bp, Artificial Sequence
  Description of Artificial Sequence: Synthetic oligonucleotide
ccccaactccctggccagca

SEQ ID NO: 3920 - DNA, 20 bp, Artificial Sequence
  Description of Artificial Sequence: Synthetic oligonucleotide
cccaactccctggccagcaa

SEQ ID NO: 3921 - DNA, 20 bp, Artificial Sequence
  Description of Artificial Sequence: Synthetic oligonucleotide
ccaactccctggccagcaag

SEQ ID NO: 3922 - DNA, 20 bp, Artificial Sequence
  Description of Artificial Sequence: Synthetic oligonucleotide
caactccctggccagcaagg

SEQ ID NO: 3923 - DNA, 20 bp, Artificial Sequence
  Description of Artificial Sequence: Synthetic oligonucleotide
aactccctggccagcaagga

SEQ ID NO: 3924 - DNA, 20 bp, Artificial Sequence
  Description of Artificial Sequence: Synthetic oligonucleotide
actccctggccagcaaggag

SEQ ID NO: 3925 - DNA, 20 bp, Artificial Sequence
  Description of Artificial Sequence: Synthetic oligonucleotide
ctccctggccagcaaggagt

SEQ ID NO: 3926 - DNA, 20 bp, Artificial Sequence
  Description of Artificial Sequence: Synthetic oligonucleotide
tccctggccagcaaggagtg

SEQ ID NO: 3927 - DNA, 20 bp, Artificial Sequence
  Description of Artificial Sequence: Synthetic oligonucleotide
ccctggccagcaaggagtga

SEQ ID NO: 3928 - DNA, 20 bp, Artificial Sequence
  Description of Artificial Sequence: Synthetic oligonucleotide
cctggccagcaaggagtgaa

SEQ ID NO: 3929 - DNA, 20 bp, Artificial Sequence
  Description of Artificial Sequence: Synthetic oligonucleotide
ctggccagcaaggagtgaag

SEQ ID NO: 3930 - DNA, 20 bp, Artificial Sequence
  Description of Artificial Sequence: Synthetic oligonucleotide
tggccagcaaggagtgaagc

SEQ ID NO: 3931 - DNA, 20 bp, Artificial Sequence
  Description of Artificial Sequence: Synthetic oligonucleotide
ggccagcaaggagtgaagct

SEQ ID NO: 3932 - DNA, 20 bp, Artificial Sequence
  Description of Artificial Sequence: Synthetic oligonucleotide
gccagcaaggagtgaagctc

SEQ ID NO: 3933 - DNA, 20 bp, Artificial Sequence
  Description of Artificial Sequence: Synthetic oligonucleotide
ccagcaaggagtgaagctcc

SEQ ID NO: 3934 - DNA, 20 bp, Artificial Sequence
  Description of Artificial Sequence: Synthetic oligonucleotide
cagcaaggagtgaagctcca

SEQ ID NO: 3935 - DNA, 20 bp, Artificial Sequence
  Description of Artificial Sequence: Synthetic oligonucleotide
agcaaggagtgaagctccat

SEQ ID NO: 3936 - DNA, 20 bp, Artificial Sequence
  Description of Artificial Sequence: Synthetic oligonucleotide
gcaaggagtgaagctccatg

SEQ ID NO: 3937 - DNA, 20 bp, Artificial Sequence
  Description of Artificial Sequence: Synthetic oligonucleotide
caaggagtgaagctccatgc

SEQ ID NO: 3938 - DNA, 20 bp, Artificial Sequence
  Description of Artificial Sequence: Synthetic oligonucleotide
aaggagtgaagctccatgcc

SEQ ID NO: 3939 - DNA, 20 bp, Artificial Sequence
  Description of Artificial Sequence: Synthetic oligonucleotide
aggagtgaagctccatgccc

SEQ ID NO: 3940 - DNA, 20 bp, Artificial Sequence
  Description of Artificial Sequence: Synthetic oligonucleotide
ggagtgaagctccatgcccc

SEQ ID NO: 3941 - DNA, 20 bp, Artificial Sequence
  Description of Artificial Sequence: Synthetic oligonucleotide
gagtgaagctccatgcccct

SEQ ID NO: 3942 - DNA, 20 bp, Artificial Sequence
  Description of Artificial Sequence: Synthetic oligonucleotide
agtgaagctccatgcccctt

SEQ ID NO: 3943 - DNA, 20 bp, Artificial Sequence
  Description of Artificial Sequence: Synthetic oligonucleotide
gtgaagctccatgccccttg

SEQ ID NO: 3944 - DNA, 20 bp, Artificial Sequence
  Description of Artificial Sequence: Synthetic oligonucleotide
tgaagctccatgccccttgg

SEQ ID NO: 3945 - DNA, 20 bp, Artificial Sequence
  Description of Artificial Sequence: Synthetic oligonucleotide
gaagctccatgccccttggt

SEQ ID NO: 3946 - DNA, 20 bp, Artificial Sequence
  Description of Artificial Sequence: Synthetic oligonucleotide
aagctccatgccccttggtc

SEQ ID NO: 3947 - DNA, 20 bp, Artificial Sequence
  Description of Artificial Sequence: Synthetic oligonucleotide
agctccatgccccttggtcc

SEQ ID NO: 3948 - DNA, 20 bp, Artificial Sequence
  Description of Artificial Sequence: Synthetic oligonucleotide
gctccatgccccttggtcca

SEQ ID NO: 3949 - DNA, 20 bp, Artificial Sequence
  Description of Artificial Sequence: Synthetic oligonucleotide
ctccatgccccttggtccac

SEQ ID NO: 3950 - DNA, 20 bp, Artificial Sequence
  Description of Artificial Sequence: Synthetic oligonucleotide
tccatgccccttggtccacg

SEQ ID NO: 3951 - DNA, 20 bp, Artificial Sequence
  Description of Artificial Sequence: Synthetic oligonucleotide
ccatgccccttggtccacgc

SEQ ID NO: 3952 - DNA, 20 bp, Artificial Sequence
  Description of Artificial Sequence: Synthetic oligonucleotide
catgccccttggtccacgcc

SEQ ID NO: 3953 - DNA, 20 bp, Artificial Sequence
  Description of Artificial Sequence: Synthetic oligonucleotide
atgccccttggtccacgcct

SEQ ID NO: 3954 - DNA, 20 bp, Artificial Sequence
  Description of Artificial Sequence: Synthetic oligonucleotide
tgccccttggtccacgcctc

SEQ ID NO: 3955 - DNA, 20 bp, Artificial Sequence
  Description of Artificial Sequence: Synthetic oligonucleotide
gccccttggtccacgcctct

SEQ ID NO: 3956 - DNA, 20 bp, Artificial Sequence
  Description of Artificial Sequence: Synthetic oligonucleotide
ccccttggtccacgcctcta

SEQ ID NO: 3957 - DNA, 20 bp, Artificial Sequence
  Description of Artificial Sequence: Synthetic oligonucleotide
cccttggtccacgcctctag

SEQ ID NO: 3958 - DNA, 20 bp, Artificial Sequence
  Description of Artificial Sequence: Synthetic oligonucleotide
ccttggtccacgcctctaga

SEQ ID NO: 3959 - DNA, 20 bp, Artificial Sequence
  Description of Artificial Sequence: Synthetic oligonucleotide
cttggtccacgcctctagag

SEQ ID NO: 3960 - DNA, 20 bp, Artificial Sequence
  Description of Artificial Sequence: Synthetic oligonucleotide
ttggtccacgcctctagagt

SEQ ID NO: 3961 - DNA, 20 bp, Artificial Sequence
  Description of Artificial Sequence: Synthetic oligonucleotide
tggtccacgcctctagagtc

SEQ ID NO: 3962 - DNA, 20 bp, Artificial Sequence
  Description of Artificial Sequence: Synthetic oligonucleotide
ggtccacgcctctagagtct

SEQ ID NO: 3963 - DNA, 20 bp, Artificial Sequence
  Description of Artificial Sequence: Synthetic oligonucleotide
gtccacgcctctagagtctg

SEQ ID NO: 3964 - DNA, 20 bp, Artificial Sequence
  Description of Artificial Sequence: Synthetic oligonucleotide
tccacgcctctagagtctga

SEQ ID NO: 3965 - DNA, 20 bp, Artificial Sequence
  Description of Artificial Sequence: Synthetic oligonucleotide
ccacgcctctagagtctgag

SEQ ID NO: 3966 - DNA, 20 bp, Artificial Sequence
  Description of Artificial Sequence: Synthetic oligonucleotide
cacgcctctagagtctgagc

SEQ ID NO: 3967 - DNA, 20 bp, Artificial Sequence
  Description of Artificial Sequence: Synthetic oligonucleotide
acgcctctagagtctgagca

SEQ ID NO: 3968 - DNA, 20 bp, Artificial Sequence
  Description of Artificial Sequence: Synthetic oligonucleotide
cgcctctagagtctgagcat

SEQ ID NO: 3969 - DNA, 20 bp, Artificial Sequence
  Description of Artificial Sequence: Synthetic oligonucleotide
gcctctagagtctgagcata

SEQ ID NO: 3970 - DNA, 20 bp, Artificial Sequence
  Description of Artificial Sequence: Synthetic oligonucleotide
cctctagagtctgagcatat

SEQ ID NO: 3971 - DNA, 20 bp, Artificial Sequence
  Description of Artificial Sequence: Synthetic oligonucleotide
ctctagagtctgagcatatc

SEQ ID NO: 3972 - DNA, 20 bp, Artificial Sequence
  Description of Artificial Sequence: Synthetic oligonucleotide
tctagagtctgagcatatcc

SEQ ID NO: 3973 - DNA, 20 bp, Artificial Sequence
  Description of Artificial Sequence: Synthetic oligonucleotide
ctagagtctgagcatatcct

SEQ ID NO: 3974 - DNA, 20 bp, Artificial Sequence
  Description of Artificial Sequence: Synthetic oligonucleotide
tagagtctgagcatatcctg

SEQ ID NO: 3975 - DNA, 20 bp, Artificial Sequence
  Description of Artificial Sequence: Synthetic oligonucleotide
agagtctgagcatatcctgc

SEQ ID NO: 3976 - DNA, 20 bp, Artificial Sequence
  Description of Artificial Sequence: Synthetic oligonucleotide
gagtctgagcatatcctgca

SEQ ID NO: 3977 - DNA, 20 bp, Artificial Sequence
  Description of Artificial Sequence: Synthetic oligonucleotide
agtctgagcatatcctgcag

SEQ ID NO: 3978 - DNA, 20 bp, Artificial Sequence
  Description of Artificial Sequence: Synthetic oligonucleotide
gtctgagcatatcctgcagc

SEQ ID NO: 3979 - DNA, 20 bp, Artificial Sequence
  Description of Artificial Sequence: Synthetic oligonucleotide
tctgagcatatcctgcagcc

SEQ ID NO: 3980 - DNA, 20 bp, Artificial Sequence
  Description of Artificial Sequence: Synthetic oligonucleotide
ctgagcatatcctgcagcct

SEQ ID NO: 3981 - DNA, 20 bp, Artificial Sequence
  Description of Artificial Sequence: Synthetic oligonucleotide
tgagcatatcctgcagcctc

SEQ ID NO: 3982 - DNA, 20 bp, Artificial Sequence
  Description of Artificial Sequence: Synthetic oligonucleotide
gagcatatcctgcagcctcg

SEQ ID NO: 3983 - DNA, 20 bp, Artificial Sequence
  Description of Artificial Sequence: Synthetic oligonucleotide
agcatatcctgcagcctcga

SEQ ID NO: 3984 - DNA, 20 bp, Artificial Sequence
  Description of Artificial Sequence: Synthetic oligonucleotide
gcatatcctgcagcctcgat

SEQ ID NO: 3985 - DNA, 20 bp, Artificial Sequence
  Description of Artificial Sequence: Synthetic oligonucleotide
catatcctgcagcctcgatc

SEQ ID NO: 3986 - DNA, 20 bp, Artificial Sequence
  Description of Artificial Sequence: Synthetic oligonucleotide
atatcctgcagcctcgatct

SEQ ID NO: 3987 - DNA, 20 bp, Artificial Sequence
  Description of Artificial Sequence: Synthetic oligonucleotide
tatcctgcagcctcgatctc

SEQ ID NO: 3988 - DNA, 20 bp, Artificial Sequence
  Description of Artificial Sequence: Synthetic oligonucleotide
atcctgcagcctcgatctca

SEQ ID NO: 3989 - DNA, 20 bp, Artificial Sequence
  Description of Artificial Sequence: Synthetic oligonucleotide
tcctgcagcctcgatctcag

SEQ ID NO: 3990 - DNA, 20 bp, Artificial Sequence
  Description of Artificial Sequence: Synthetic oligonucleotide
cctgcagcctcgatctcagg

SEQ ID NO: 3991 - DNA, 20 bp, Artificial Sequence
  Description of Artificial Sequence: Synthetic oligonucleotide
ctgcagcctcgatctcagga

SEQ ID NO: 3992 - DNA, 20 bp, Artificial Sequence
  Description of Artificial Sequence: Synthetic oligonucleotide
tgcagcctcgatctcaggag

SEQ ID NO: 3993 - DNA, 20 bp, Artificial Sequence
  Description of Artificial Sequence: Synthetic oligonucleotide
gcagcctcgatctcaggagg

SEQ ID NO: 3994 - DNA, 20 bp, Artificial Sequence
  Description of Artificial Sequence: Synthetic oligonucleotide
cagcctcgatctcaggaggc

SEQ ID NO: 3995 - DNA, 20 bp, Artificial Sequence
  Description of Artificial Sequence: Synthetic oligonucleotide
agcctcgatctcaggaggca

SEQ ID NO: 3996 - DNA, 20 bp, Artificial Sequence
  Description of Artificial Sequence: Synthetic oligonucleotide
gcctcgatctcaggaggcaa

SEQ ID NO: 3997 - DNA, 20 bp, Artificial Sequence
  Description of Artificial Sequence: Synthetic oligonucleotide
cctcgatctcaggaggcaac

SEQ ID NO: 3998 - DNA, 20 bp, Artificial Sequence
  Description of Artificial Sequence: Synthetic oligonucleotide
ctcgatctcaggaggcaacg

SEQ ID NO: 3999 - DNA, 20 bp, Artificial Sequence
  Description of Artificial Sequence: Synthetic oligonucleotide
tcgatctcaggaggcaacgc

SEQ ID NO: 4000 - DNA, 20 bp, Artificial Sequence
  Description of Artificial Sequence: Synthetic oligonucleotide
cgatctcaggaggcaacgca

SEQ ID NO: 4001 - DNA, 20 bp, Artificial Sequence
  Description of Artificial Sequence: Synthetic oligonucleotide
gatctcaggaggcaacgcat

SEQ ID NO: 4002 - DNA, 20 bp, Artificial Sequence
  Description of Artificial Sequence: Synthetic oligonucleotide
atctcaggaggcaacgcatg

SEQ ID NO: 4003 - DNA, 20 bp, Artificial Sequence
  Description of Artificial Sequence: Synthetic oligonucleotide
tctcaggaggcaacgcatgc

SEQ ID NO: 4004 - DNA, 20 bp, Artificial Sequence
  Description of Artificial Sequence: Synthetic oligonucleotide
ctcaggaggcaacgcatgca

SEQ ID NO: 4005 - DNA, 20 bp, Artificial Sequence
  Description of Artificial Sequence: Synthetic oligonucleotide
tcaggaggcaacgcatgcag

SEQ ID NO: 4006 - DNA, 20 bp, Artificial Sequence
  Description of Artificial Sequence: Synthetic oligonucleotide
caggaggcaacgcatgcagc

SEQ ID NO: 4007 - DNA, 20 bp, Artificial Sequence
  Description of Artificial Sequence: Synthetic oligonucleotide
aggaggcaacgcatgcagcc

SEQ ID NO: 4008 - DNA, 20 bp, Artificial Sequence
  Description of Artificial Sequence: Synthetic oligonucleotide
ggaggcaacgcatgcagccc

SEQ ID NO: 4009 - DNA, 20 bp, Artificial Sequence
  Description of Artificial Sequence: Synthetic oligonucleotide
gaggcaacgcatgcagcccc

SEQ ID NO: 4010 - DNA, 20 bp, Artificial Sequence
  Description of Artificial Sequence: Synthetic oligonucleotide
aggcaacgcatgcagccccc

SEQ ID NO: 4011 - DNA, 20 bp, Artificial Sequence
  Description of Artificial Sequence: Synthetic oligonucleotide
ggcaacgcatgcagcccccc

SEQ ID NO: 4012 - DNA, 20 bp, Artificial Sequence
  Description of Artificial Sequence: Synthetic oligonucleotide
gcaacgcatgcagcccccct

SEQ ID NO: 4013 - DNA, 20 bp, Artificial Sequence
  Description of Artificial Sequence: Synthetic oligonucleotide
caacgcatgcagcccccctg

SEQ ID NO: 4014 - DNA, 20 bp, Artificial Sequence
  Description of Artificial Sequence: Synthetic oligonucleotide
aacgcatgcagcccccctgc

SEQ ID NO: 4015 - DNA, 20 bp, Artificial Sequence
  Description of Artificial Sequence: Synthetic oligonucleotide
acgcatgcagcccccctgca

SEQ ID NO: 4016 - DNA, 20 bp, Artificial Sequence
  Description of Artificial Sequence: Synthetic oligonucleotide
cgcatgcagcccccctgcac

SEQ ID NO: 4017 - DNA, 20 bp, Artificial Sequence
  Description of Artificial Sequence: Synthetic oligonucleotide
gcatgcagcccccctgcact

SEQ ID NO: 4018 - DNA, 20 bp, Artificial Sequence
  Description of Artificial Sequence: Synthetic oligonucleotide
catgcagcccccctgcactc

SEQ ID NO: 4019 - DNA, 20 bp, Artificial Sequence
  Description of Artificial Sequence: Synthetic oligonucleotide
atgcagcccccctgcactca

SEQ ID NO: 4020 - DNA, 20 bp, Artificial Sequence
  Description of Artificial Sequence: Synthetic oligonucleotide
tgcagcccccctgcactcag

SEQ ID NO: 4021 - DNA, 20 bp, Artificial Sequence
  Description of Artificial Sequence: Synthetic oligonucleotide
gcagcccccctgcactcaga

SEQ ID NO: 4022 - DNA, 20 bp, Artificial Sequence
  Description of Artificial Sequence: Synthetic oligonucleotide
cagcccccctgcactcagaa

SEQ ID NO: 4023 - DNA, 20 bp, Artificial Sequence
  Description of Artificial Sequence: Synthetic oligonucleotide
agcccccctgcactcagaaa

SEQ ID NO: 4024 - DNA, 20 bp, Artificial Sequence
  Description of Artificial Sequence: Synthetic oligonucleotide
gcccccctgcactcagaaag

SEQ ID NO: 4025 - DNA, 20 bp, Artificial Sequence
  Description of Artificial Sequence: Synthetic oligonucleotide
cccccctgcactcagaaagg

SEQ ID NO: 4026 - DNA, 20 bp, Artificial Sequence
  Description of Artificial Sequence: Synthetic oligonucleotide
ccccctgcactcagaaaggg

SEQ ID NO: 4027 - DNA, 20 bp, Artificial Sequence
  Description of Artificial Sequence: Synthetic oligonucleotide
cccctgcactcagaaagggg

SEQ ID NO: 4028 - DNA, 20 bp, Artificial Sequence
  Description of Artificial Sequence: Synthetic oligonucleotide
ccctgcactcagaaaggggg

SEQ ID NO: 4029 - DNA, 20 bp, Artificial Sequence
  Description of Artificial Sequence: Synthetic oligonucleotide
cctgcactcagaaagggggc

SEQ ID NO: 4030 - DNA, 20 bp, Artificial Sequence
  Description of Artificial Sequence: Synthetic oligonucleotide
ctgcactcagaaagggggct

SEQ ID NO: 4031 - DNA, 20 bp, Artificial Sequence
  Description of Artificial Sequence: Synthetic oligonucleotide
tgcactcagaaagggggctt

SEQ ID NO: 4032 - DNA, 20 bp, Artificial Sequence
  Description of Artificial Sequence: Synthetic oligonucleotide
gcactcagaaagggggcttc

SEQ ID NO: 4033 - DNA, 20 bp, Artificial Sequence
  Description of Artificial Sequence: Synthetic oligonucleotide
cactcagaaagggggcttct

SEQ ID NO: 4034 - DNA, 20 bp, Artificial Sequence
  Description of Artificial Sequence: Synthetic oligonucleotide
actcagaaagggggcttctc

SEQ ID NO: 4035 - DNA, 20 bp, Artificial Sequence
  Description of Artificial Sequence: Synthetic oligonucleotide
ctcagaaagggggcttctcc

SEQ ID NO: 4036 - DNA, 20 bp, Artificial Sequence
  Description of Artificial Sequence: Synthetic oligonucleotide
tcagaaagggggcttctcca

SEQ ID NO: 4037 - DNA, 20 bp, Artificial Sequence
  Description of Artificial Sequence: Synthetic oligonucleotide
cagaaagggggcttctccag

SEQ ID NO: 4038 - DNA, 20 bp, Artificial Sequence
  Description of Artificial Sequence: Synthetic oligonucleotide
agaaagggggcttctccagt

SEQ ID NO: 4039 - DNA, 20 bp, Artificial Sequence
  Description of Artificial Sequence: Synthetic oligonucleotide
gaaagggggcttctccagtc

SEQ ID NO: 4040 - DNA, 20 bp, Artificial Sequence
  Description of Artificial Sequence: Synthetic oligonucleotide
aaagggggcttctccagtcg

SEQ ID NO: 4041 - DNA, 20 bp, Artificial Sequence
  Description of Artificial Sequence: Synthetic oligonucleotide
aagggggcttctccagtcgt

SEQ ID NO: 4042 - DNA, 20 bp, Artificial Sequence
  Description of Artificial Sequence: Synthetic oligonucleotide
agggggcttctccagtcgtg

SEQ ID NO: 4043 - DNA, 20 bp, Artificial Sequence
  Description of Artificial Sequence: Synthetic oligonucleotide
gggggcttctccagtcgtgg

SEQ ID NO: 4044 - DNA, 20 bp, Artificial Sequence
  Description of Artificial Sequence: Synthetic oligonucleotide
ggggcttctccagtcgtggt

SEQ ID NO: 4045 - DNA, 20 bp, Artificial Sequence
  Description of Artificial Sequence: Synthetic oligonucleotide
gggcttctccagtcgtggtc

SEQ ID NO: 4046 - DNA, 20 bp, Artificial Sequence
  Description of Artificial Sequence: Synthetic oligonucleotide
ggcttctccagtcgtggtct

SEQ ID NO: 4047 - DNA, 20 bp, Artificial Sequence
  Description of Artificial Sequence: Synthetic oligonucleotide
gcttctccagtcgtggtctt

SEQ ID NO: 4048 - DNA, 20 bp, Artificial Sequence
  Description of Artificial Sequence: Synthetic oligonucleotide
cttctccagtcgtggtcttc

SEQ ID NO: 4049 - DNA, 20 bp, Artificial Sequence
  Description of Artificial Sequence: Synthetic oligonucleotide
ttctccagtcgtggtcttct

SEQ ID NO: 4050 - DNA, 20 bp, Artificial Sequence
  Description of Artificial Sequence: Synthetic oligonucleotide
tctccagtcgtggtcttctt

SEQ ID NO: 4051 - DNA, 20 bp, Artificial Sequence
  Description of Artificial Sequence: Synthetic oligonucleotide
ctccagtcgtggtcttcttc

SEQ ID NO: 4052 - DNA, 20 bp, Artificial Sequence
  Description of Artificial Sequence: Synthetic oligonucleotide
tccagtcgtggtcttcttct

SEQ ID NO: 4053 - DNA, 20 bp, Artificial Sequence
  Description of Artificial Sequence: Synthetic oligonucleotide
ccagtcgtggtcttcttctc

SEQ ID NO: 4054 - DNA, 20 bp, Artificial Sequence
  Description of Artificial Sequence: Synthetic oligonucleotide
cagtcgtggtcttcttctct

SEQ ID NO: 4055 - DNA, 20 bp, Artificial Sequence
  Description of Artificial Sequence: Synthetic oligonucleotide
agtcgtggtcttcttctctg

SEQ ID NO: 4056 - DNA, 20 bp, Artificial Sequence
  Description of Artificial Sequence: Synthetic oligonucleotide
gtcgtggtcttcttctctgt

SEQ ID NO: 4057 - DNA, 20 bp, Artificial Sequence
  Description of Artificial Sequence: Synthetic oligonucleotide
tcgtggtcttcttctctgtc

SEQ ID NO: 4058 - DNA, 20 bp, Artificial Sequence
  Description of Artificial Sequence: Synthetic oligonucleotide
cgtggtcttcttctctgtcc

SEQ ID NO: 4059 - DNA, 20 bp, Artificial Sequence
  Description of Artificial Sequence: Synthetic oligonucleotide
gtggtcttcttctctgtcca

SEQ ID NO: 4060 - DNA, 20 bp, Artificial Sequence
  Description of Artificial Sequence: Synthetic oligonucleotide
tggtcttcttctctgtccac

SEQ ID NO: 4061 - DNA, 20 bp, Artificial Sequence
  Description of Artificial Sequence: Synthetic oligonucleotide
ggtcttcttctctgtccaca

SEQ ID NO: 4062 - DNA, 20 bp, Artificial Sequence
  Description of Artificial Sequence: Synthetic oligonucleotide
gtcttcttctctgtccacaa

SEQ ID NO: 4063 - DNA, 20 bp, Artificial Sequence
  Description of Artificial Sequence: Synthetic oligonucleotide
tcttcttctctgtccacaag

SEQ ID NO: 4064 - DNA, 20 bp, Artificial Sequence
  Description of Artificial Sequence: Synthetic oligonucleotide
cttcttctctgtccacaagt

SEQ ID NO: 4065 - DNA, 20 bp, Artificial Sequence
  Description of Artificial Sequence: Synthetic oligonucleotide
ttcttctctgtccacaagtt

SEQ ID NO: 4066 - DNA, 20 bp, Artificial Sequence
  Description of Artificial Sequence: Synthetic oligonucleotide
tcttctctgtccacaagttt

SEQ ID NO: 4067 - DNA, 20 bp, Artificial Sequence
  Description of Artificial Sequence: Synthetic oligonucleotide
cttctctgtccacaagtttc

SEQ ID NO: 4068 - DNA, 20 bp, Artificial Sequence
  Description of Artificial Sequence: Synthetic oligonucleotide
ttctctgtccacaagtttcc

SEQ ID NO: 4069 - DNA, 20 bp, Artificial Sequence
  Description of Artificial Sequence: Synthetic oligonucleotide
tctctgtccacaagtttcca

SEQ ID NO: 4070 - DNA, 20 bp, Artificial Sequence
  Description of Artificial Sequence: Synthetic oligonucleotide
ctctgtccacaagtttccag

SEQ ID NO: 4071 - DNA, 20 bp, Artificial Sequence
  Description of Artificial Sequence: Synthetic oligonucleotide
tctgtccacaagtttccaga

SEQ ID NO: 4072 - DNA, 20 bp, Artificial Sequence
  Description of Artificial Sequence: Synthetic oligonucleotide
ctgtccacaagtttccagat

SEQ ID NO: 4073 - DNA, 20 bp, Artificial Sequence
  Description of Artificial Sequence: Synthetic oligonucleotide
tgtccacaagtttccagatg

SEQ ID NO: 4074 - DNA, 20 bp, Artificial Sequence
  Description of Artificial Sequence: Synthetic oligonucleotide
gtccacaagtttccagatgg

SEQ ID NO: 4075 - DNA, 20 bp, Artificial Sequence
  Description of Artificial Sequence: Synthetic oligonucleotide
tccacaagtttccagatggc

SEQ ID NO: 4076 - DNA, 20 bp, Artificial Sequence
  Description of Artificial Sequence: Synthetic oligonucleotide
ccacaagtttccagatggcc

SEQ ID NO: 4077 - DNA, 20 bp, Artificial Sequence
  Description of Artificial Sequence: Synthetic oligonucleotide
cacaagtttccagatggccc

SEQ ID NO: 4078 - DNA, 20 bp, Artificial Sequence
  Description of Artificial Sequence: Synthetic oligonucleotide
acaagtttccagatggcccc

SEQ ID NO: 4079 - DNA, 20 bp, Artificial Sequence
  Description of Artificial Sequence: Synthetic oligonucleotide
caagtttccagatggcccct

SEQ ID NO: 4080 - DNA, 20 bp, Artificial Sequence
  Description of Artificial Sequence: Synthetic oligonucleotide
aagtttccagatggcccctc

SEQ ID NO: 4081 - DNA, 20 bp, Artificial Sequence
  Description of Artificial Sequence: Synthetic oligonucleotide
agtttccagatggcccctcc

SEQ ID NO: 4082 - DNA, 20 bp, Artificial Sequence
  Description of Artificial Sequence: Synthetic oligonucleotide
gtttccagatggcccctcct

SEQ ID NO: 4083 - DNA, 20 bp, Artificial Sequence
  Description of Artificial Sequence: Synthetic oligonucleotide
tttccagatggcccctcctt

SEQ ID NO: 4084 - DNA, 20 bp, Artificial Sequence
  Description of Artificial Sequence: Synthetic oligonucleotide
ttccagatggcccctccttg

SEQ ID NO: 4085 - DNA, 20 bp, Artificial Sequence
  Description of Artificial Sequence: Synthetic oligonucleotide
tccagatggcccctccttgg

SEQ ID NO: 4086 - DNA, 20 bp, Artificial Sequence
  Description of Artificial Sequence: Synthetic oligonucleotide
ccagatggcccctccttgga

SEQ ID NO: 4087 - DNA, 20 bp, Artificial Sequence
  Description of Artificial Sequence: Synthetic oligonucleotide
cagatggcccctccttggag

SEQ ID NO: 4088 - DNA, 20 bp, Artificial Sequence
  Description of Artificial Sequence: Synthetic oligonucleotide
agatggcccctccttggagc

SEQ ID NO: 4089 - DNA, 20 bp, Artificial Sequence
  Description of Artificial Sequence: Synthetic oligonucleotide
gatggcccctccttggagcc

SEQ ID NO: 4090 - DNA, 20 bp, Artificial Sequence
  Description of Artificial Sequence: Synthetic oligonucleotide
atggcccctccttggagccc

SEQ ID NO: 4091 - DNA, 20 bp, Artificial Sequence
  Description of Artificial Sequence: Synthetic oligonucleotide
tggcccctccttggagcccc

SEQ ID NO: 4092 - DNA, 20 bp, Artificial Sequence
  Description of Artificial Sequence: Synthetic oligonucleotide
ggcccctccttggagcccct

SEQ ID NO: 4093 - DNA, 20 bp, Artificial Sequence
  Description of Artificial Sequence: Synthetic oligonucleotide
gcccctccttggagcccctg

SEQ ID NO: 4094 - DNA, 20 bp, Artificial Sequence
  Description of Artificial Sequence: Synthetic oligonucleotide
cccctccttggagcccctgc

SEQ ID NO: 4095 - DNA, 20 bp, Artificial Sequence
  Description of Artificial Sequence: Synthetic oligonucleotide
ccctccttggagcccctgcc

SEQ ID NO: 4096 - DNA, 20 bp, Artificial Sequence
  Description of Artificial Sequence: Synthetic oligonucleotide
cctccttggagcccctgccc

SEQ ID NO: 4097 - DNA, 20 bp, Artificial Sequence
  Description of Artificial Sequence: Synthetic oligonucleotide
ctccttggagcccctgccca

SEQ ID NO: 4098 - DNA, 20 bp, Artificial Sequence
  Description of Artificial Sequence: Synthetic oligonucleotide
tccttggagcccctgcccag

SEQ ID NO: 4099 - DNA, 20 bp, Artificial Sequence
  Description of Artificial Sequence: Synthetic oligonucleotide
ccttggagcccctgcccagg

SEQ ID NO: 4100 - DNA, 20 bp, Artificial Sequence
  Description of Artificial Sequence: Synthetic oligonucleotide
cttggagcccctgcccaggc

SEQ ID NO: 4101 - DNA, 20 bp, Artificial Sequence
  Description of Artificial Sequence: Synthetic oligonucleotide
ttggagcccctgcccaggca

SEQ ID NO: 4102 - DNA, 20 bp, Artificial Sequence
  Description of Artificial Sequence: Synthetic oligonucleotide
tggagcccctgcccaggcag

SEQ ID NO: 4103 - DNA, 20 bp, Artificial Sequence
  Description of Artificial Sequence: Synthetic oligonucleotide
ggagcccctgcccaggcagg

SEQ ID NO: 4104 - DNA, 20 bp, Artificial Sequence
  Description of Artificial Sequence: Synthetic oligonucleotide
gagcccctgcccaggcaggg

SEQ ID NO: 4105 - DNA, 20 bp, Artificial Sequence
  Description of Artificial Sequence: Synthetic oligonucleotide
agcccctgcccaggcaggga

SEQ ID NO: 4106 - DNA, 20 bp, Artificial Sequence
  Description of Artificial Sequence: Synthetic oligonucleotide
gcccctgcccaggcagggaa

SEQ ID NO: 4107 - DNA, 20 bp, Artificial Sequence
  Description of Artificial Sequence: Synthetic oligonucleotide
cccctgcccaggcagggaac

SEQ ID NO: 4108 - DNA, 20 bp, Artificial Sequence
  Description of Artificial Sequence: Synthetic oligonucleotide
ccctgcccaggcagggaacg

SEQ ID NO: 4109 - DNA, 20 bp, Artificial Sequence
  Description of Artificial Sequence: Synthetic oligonucleotide
cctgcccaggcagggaacgg

SEQ ID NO: 4110 - DNA, 20 bp, Artificial Sequence
  Description of Artificial Sequence: Synthetic oligonucleotide
ctgcccaggcagggaacggc

SEQ ID NO: 4111 - DNA, 20 bp, Artificial Sequence
  Description of Artificial Sequence: Synthetic oligonucleotide
tgcccaggcagggaacggcc

SEQ ID NO: 4112 - DNA, 20 bp, Artificial Sequence
  Description of Artificial Sequence: Synthetic oligonucleotide
gcccaggcagggaacggcca

SEQ ID NO: 4113 - DNA, 20 bp, Artificial Sequence
  Description of Artificial Sequence: Synthetic oligonucleotide
cccaggcagggaacggccac

SEQ ID NO: 4114 - DNA, 20 bp, Artificial Sequence
  Description of Artificial Sequence: Synthetic oligonucleotide
ccaggcagggaacggccaca

SEQ ID NO: 4115 - DNA, 20 bp, Artificial Sequence
  Description of Artificial Sequence: Synthetic oligonucleotide
caggcagggaacggccacat

SEQ ID NO: 4116 - DNA, 20 bp, Artificial Sequence
  Description of Artificial Sequence: Synthetic oligonucleotide
aggcagggaacggccacatc

SEQ ID NO: 4117 - DNA, 20 bp, Artificial Sequence
  Description of Artificial Sequence: Synthetic oligonucleotide
ggcagggaacggccacatcc

SEQ ID NO: 4118 - DNA, 20 bp, Artificial Sequence
  Description of Artificial Sequence: Synthetic oligonucleotide
gcagggaacggccacatcct

SEQ ID NO: 4119 - DNA, 20 bp, Artificial Sequence
  Description of Artificial Sequence: Synthetic oligonucleotide
cagggaacggccacatcctc

SEQ ID NO: 4120 - DNA, 20 bp, Artificial Sequence
  Description of Artificial Sequence: Synthetic oligonucleotide
agggaacggccacatcctcg

SEQ ID NO: 4121 - DNA, 20 bp, Artificial Sequence
  Description of Artificial Sequence: Synthetic oligonucleotide
gggaacggccacatcctcgg

SEQ ID NO: 4122 - DNA, 20 bp, Artificial Sequence
  Description of Artificial Sequence: Synthetic oligonucleotide
ggaacggccacatcctcggg

SEQ ID NO: 4123 - DNA, 20 bp, Artificial Sequence
  Description of Artificial Sequence: Synthetic oligonucleotide
gaacggccacatcctcgggc

SEQ ID NO: 4124 - DNA, 20 bp, Artificial Sequence
  Description of Artificial Sequence: Synthetic oligonucleotide
aacggccacatcctcgggca

SEQ ID NO: 4125 - DNA, 20 bp, Artificial Sequence
  Description of Artificial Sequence: Synthetic oligonucleotide
acggccacatcctcgggcag

SEQ ID NO: 4126 - DNA, 20 bp, Artificial Sequence
  Description of Artificial Sequence: Synthetic oligonucleotide
cggccacatcctcgggcaga

SEQ ID NO: 4127 - DNA, 20 bp, Artificial Sequence
  Description of Artificial Sequence: Synthetic oligonucleotide
ggccacatcctcgggcagag

SEQ ID NO: 4128 - DNA, 20 bp, Artificial Sequence
  Description of Artificial Sequence: Synthetic oligonucleotide
gccacatcctcgggcagagc

SEQ ID NO: 4129 - DNA, 20 bp, Artificial Sequence
  Description of Artificial Sequence: Synthetic oligonucleotide
ccacatcctcgggcagagcc

SEQ ID NO: 4130 - DNA, 20 bp, Artificial Sequence
  Description of Artificial Sequence: Synthetic oligonucleotide
cacatcctcgggcagagcca

SEQ ID NO: 4131 - DNA, 20 bp, Artificial Sequence
  Description of Artificial Sequence: Synthetic oligonucleotide
acatcctcgggcagagccaa

SEQ ID NO: 4132 - DNA, 20 bp, Artificial Sequence
  Description of Artificial Sequence: Synthetic oligonucleotide
catcctcgggcagagccaag

SEQ ID NO: 4133 - DNA, 20 bp, Artificial Sequence
  Description of Artificial Sequence: Synthetic oligonucleotide
atcctcgggcagagccaaga

SEQ ID NO: 4134 - DNA, 20 bp, Artificial Sequence
  Description of Artificial Sequence: Synthetic oligonucleotide
tcctcgggcagagccaagag

SEQ ID NO: 4135 - DNA, 20 bp, Artificial Sequence
  Description of Artificial Sequence: Synthetic oligonucleotide
cctcgggcagagccaagagt

SEQ ID NO: 4136 - DNA, 20 bp, Artificial Sequence
  Description of Artificial Sequence: Synthetic oligonucleotide
ctcgggcagagccaagagtc

SEQ ID NO: 4137 - DNA, 20 bp, Artificial Sequence
  Description of Artificial Sequence: Synthetic oligonucleotide
tcgggcagagccaagagtca

SEQ ID NO: 4138 - DNA, 20 bp, Artificial Sequence
  Description of Artificial Sequence: Synthetic oligonucleotide
cgggcagagccaagagtcac

SEQ ID NO: 4139 - DNA, 20 bp, Artificial Sequence
  Description of Artificial Sequence: Synthetic oligonucleotide
gggcagagccaagagtcacc

SEQ ID NO: 4140 - DNA, 20 bp, Artificial Sequence
  Description of Artificial Sequence: Synthetic oligonucleotide
ggcagagccaagagtcaccg

SEQ ID NO: 4141 - DNA, 20 bp, Artificial Sequence
  Description of Artificial Sequence: Synthetic oligonucleotide
gcagagccaagagtcaccgt

SEQ ID NO: 4142 - DNA, 20 bp, Artificial Sequence
  Description of Artificial Sequence: Synthetic oligonucleotide
cagagccaagagtcaccgtc

SEQ ID NO: 4143 - DNA, 20 bp, Artificial Sequence
  Description of Artificial Sequence: Synthetic oligonucleotide
agagccaagagtcaccgtct

SEQ ID NO: 4144 - DNA, 20 bp, Artificial Sequence
  Description of Artificial Sequence: Synthetic oligonucleotide
gagccaagagtcaccgtctt

SEQ ID NO: 4145 - DNA, 20 bp, Artificial Sequence
  Description of Artificial Sequence: Synthetic oligonucleotide
agccaagagtcaccgtcttt

SEQ ID NO: 4146 - DNA, 20 bp, Artificial Sequence
  Description of Artificial Sequence: Synthetic oligonucleotide
gccaagagtcaccgtctttc

SEQ ID NO: 4147 - DNA, 20 bp, Artificial Sequence
  Description of Artificial Sequence: Synthetic oligonucleotide
ccaagagtcaccgtctttcg

SEQ ID NO: 4148 - DNA, 20 bp, Artificial Sequence
  Description of Artificial Sequence: Synthetic oligonucleotide
caagagtcaccgtctttcgt

SEQ ID NO: 4149 - DNA, 20 bp, Artificial Sequence
  Description of Artificial Sequence: Synthetic oligonucleotide
aagagtcaccgtctttcgtg

SEQ ID NO: 4150 - DNA, 20 bp, Artificial Sequence
  Description of Artificial Sequence: Synthetic oligonucleotide
agagtcaccgtctttcgtgg

SEQ ID NO: 4151 - DNA, 20 bp, Artificial Sequence
  Description of Artificial Sequence: Synthetic oligonucleotide
gagtcaccgtctttcgtggg

SEQ ID NO: 4152 - DNA, 20 bp, Artificial Sequence
  Description of Artificial Sequence: Synthetic oligonucleotide
agtcaccgtctttcgtgggc

SEQ ID NO: 4153 - DNA, 20 bp, Artificial Sequence
  Description of Artificial Sequence: Synthetic oligonucleotide
gtcaccgtctttcgtgggcc

SEQ ID NO: 4154 - DNA, 20 bp, Artificial Sequence
  Description of Artificial Sequence: Synthetic oligonucleotide
tcaccgtctttcgtgggcct

SEQ ID NO: 4155 - DNA, 20 bp, Artificial Sequence
  Description of Artificial Sequence: Synthetic oligonucleotide
caccgtctttcgtgggcctg

SEQ ID NO: 4156 - DNA, 20 bp, Artificial Sequence
  Description of Artificial Sequence: Synthetic oligonucleotide
accgtctttcgtgggcctgg

SEQ ID NO: 4157 - DNA, 20 bp, Artificial Sequence
  Description of Artificial Sequence: Synthetic oligonucleotide
ccgtctttcgtgggcctggg

SEQ ID NO: 4158 - DNA, 20 bp, Artificial Sequence
  Description of Artificial Sequence: Synthetic oligonucleotide
cgtctttcgtgggcctggga

SEQ ID NO: 4159 - DNA, 20 bp, Artificial Sequence
  Description of Artificial Sequence: Synthetic oligonucleotide
gtctttcgtgggcctgggac

SEQ ID NO: 4160 - DNA, 20 bp, Artificial Sequence
  Description of Artificial Sequence: Synthetic oligonucleotide
tctttcgtgggcctgggacc

SEQ ID NO: 4161 - DNA, 20 bp, Artificial Sequence
  Description of Artificial Sequence: Synthetic oligonucleotide
ctttcgtgggcctgggacca

SEQ ID NO: 4162 - DNA, 20 bp, Artificial Sequence
  Description of Artificial Sequence: Synthetic oligonucleotide
tttcgtgggcctgggaccag

SEQ ID NO: 4163 - DNA, 20 bp, Artificial Sequence
  Description of Artificial Sequence: Synthetic oligonucleotide
ttcgtgggcctgggaccagg

SEQ ID NO: 4164 - DNA, 20 bp, Artificial Sequence
  Description of Artificial Sequence: Synthetic oligonucleotide
tcgtgggcctgggaccaggc

SEQ ID NO: 4165 - DNA, 20 bp, Artificial Sequence
  Description of Artificial Sequence: Synthetic oligonucleotide
cgtgggcctgggaccaggcc

SEQ ID NO: 4166 - DNA, 20 bp, Artificial Sequence
  Description of Artificial Sequence: Synthetic oligonucleotide
gtgggcctgggaccaggccc

SEQ ID NO: 4167 - DNA, 20 bp, Artificial Sequence
  Description of Artificial Sequence: Synthetic oligonucleotide
tgggcctgggaccaggccca

SEQ ID NO: 4168 - DNA, 20 bp, Artificial Sequence
  Description of Artificial Sequence: Synthetic oligonucleotide
gggcctgggaccaggcccag

SEQ ID NO: 4169 - DNA, 20 bp, Artificial Sequence
  Description of Artificial Sequence: Synthetic oligonucleotide
ggcctgggaccaggcccagc

SEQ ID NO: 4170 - DNA, 20 bp, Artificial Sequence
  Description of Artificial Sequence: Synthetic oligonucleotide
gcctgggaccaggcccagcc

SEQ ID NO: 4171 - DNA, 20 bp, Artificial Sequence
  Description of Artificial Sequence: Synthetic oligonucleotide
cctgggaccaggcccagcca

SEQ ID NO: 4172 - DNA, 20 bp, Artificial Sequence
  Description of Artificial Sequence: Synthetic oligonucleotide
ctgggaccaggcccagccag

SEQ ID NO: 4173 - DNA, 20 bp, Artificial Sequence
  Description of Artificial Sequence: Synthetic oligonucleotide
tgggaccaggcccagccagg

SEQ ID NO: 4174 - DNA, 20 bp, Artificial Sequence
  Description of Artificial Sequence: Synthetic oligonucleotide
gggaccaggcccagccagga

SEQ ID NO: 4175 - DNA, 20 bp, Artificial Sequence
  Description of Artificial Sequence: Synthetic oligonucleotide
ggaccaggcccagccaggac

SEQ ID NO: 4176 - DNA, 20 bp, Artificial Sequence
  Description of Artificial Sequence: Synthetic oligonucleotide
gaccaggcccagccaggacg

SEQ ID NO: 4177 - DNA, 20 bp, Artificial Sequence
  Description of Artificial Sequence: Synthetic oligonucleotide
accaggcccagccaggacgc

SEQ ID NO: 4178 - DNA, 20 bp, Artificial Sequence
  Description of Artificial Sequence: Synthetic oligonucleotide
ccaggcccagccaggacgct

SEQ ID NO: 4179 - DNA, 20 bp, Artificial Sequence
  Description of Artificial Sequence: Synthetic oligonucleotide
caggcccagccaggacgcta

SEQ ID NO: 4180 - DNA, 20 bp, Artificial Sequence
  Description of Artificial Sequence: Synthetic oligonucleotide
aggcccagccaggacgctag

SEQ ID NO: 4181 - DNA, 20 bp, Artificial Sequence
  Description of Artificial Sequence: Synthetic oligonucleotide
ggcccagccaggacgctagg

SEQ ID NO: 4182 - DNA, 20 bp, Artificial Sequence
  Description of Artificial Sequence: Synthetic oligonucleotide
gcccagccaggacgctagga

SEQ ID NO: 4183 - DNA, 20 bp, Artificial Sequence
  Description of Artificial Sequence: Synthetic oligonucleotide
cccagccaggacgctaggag

SEQ ID NO: 4184 - DNA, 20 bp, Artificial Sequence
  Description of Artificial Sequence: Synthetic oligonucleotide
ccagccaggacgctaggagg

SEQ ID NO: 4185 - DNA, 20 bp, Artificial Sequence
  Description of Artificial Sequence: Synthetic oligonucleotide
cagccaggacgctaggaggc

SEQ ID NO: 4186 - DNA, 20 bp, Artificial Sequence
  Description of Artificial Sequence: Synthetic oligonucleotide
agccaggacgctaggaggct

SEQ ID NO: 4187 - DNA, 20 bp, Artificial Sequence
  Description of Artificial Sequence: Synthetic oligonucleotide
gccaggacgctaggaggctg

SEQ ID NO: 4188 - DNA, 20 bp, Artificial Sequence
  Description of Artificial Sequence: Synthetic oligonucleotide
ccaggacgctaggaggctgc

SEQ ID NO: 4189 - DNA, 20 bp, Artificial Sequence
  Description of Artificial Sequence: Synthetic oligonucleotide
caggacgctaggaggctgcc

SEQ ID NO: 4190 - DNA, 20 bp, Artificial Sequence
  Description of Artificial Sequence: Synthetic oligonucleotide
aggacgctaggaggctgcct

SEQ ID NO: 4191 - DNA, 20 bp, Artificial Sequence
  Description of Artificial Sequence: Synthetic oligonucleotide
ggacgctaggaggctgcctc

SEQ ID NO: 4192 - DNA, 20 bp, Artificial Sequence
  Description of Artificial Sequence: Synthetic oligonucleotide
gacgctaggaggctgcctct

SEQ ID NO: 4193 - DNA, 20 bp, Artificial Sequence
  Description of Artificial Sequence: Synthetic oligonucleotide
acgctaggaggctgcctctg

SEQ ID NO: 4194 - DNA, 20 bp, Artificial Sequence
  Description of Artificial Sequence: Synthetic oligonucleotide
cgctaggaggctgcctctgc

SEQ ID NO: 4195 - DNA, 20 bp, Artificial Sequence
  Description of Artificial Sequence: Synthetic oligonucleotide
gctaggaggctgcctctgct

SEQ ID NO: 4196 - DNA, 20 bp, Artificial Sequence
  Description of Artificial Sequence: Synthetic oligonucleotide
ctaggaggctgcctctgctg

SEQ ID NO: 4197 - DNA, 20 bp, Artificial Sequence
  Description of Artificial Sequence: Synthetic oligonucleotide
taggaggctgcctctgctgc

SEQ ID NO: 4198 - DNA, 20 bp, Artificial Sequence
  Description of Artificial Sequence: Synthetic oligonucleotide
aggaggctgcctctgctgcc

SEQ ID NO: 4199 - DNA, 20 bp, Artificial Sequence
  Description of Artificial Sequence: Synthetic oligonucleotide
ggaggctgcctctgctgcca

SEQ ID NO: 4200 - DNA, 20 bp, Artificial Sequence
  Description of Artificial Sequence: Synthetic oligonucleotide
gaggctgcctctgctgccat

SEQ ID NO: 4201 - DNA, 20 bp, Artificial Sequence
  Description of Artificial Sequence: Synthetic oligonucleotide
aggctgcctctgctgccatg

SEQ ID NO: 4202 - DNA, 20 bp, Artificial Sequence
  Description of Artificial Sequence: Synthetic oligonucleotide
ggctgcctctgctgccatgg

SEQ ID NO: 4203 - DNA, 20 bp, Artificial Sequence
  Description of Artificial Sequence: Synthetic oligonucleotide
gctgcctctgctgccatggg

SEQ ID NO: 4204 - DNA, 20 bp, Artificial Sequence
  Description of Artificial Sequence: Synthetic oligonucleotide
ctgcctctgctgccatgggc

SEQ ID NO: 4205 - DNA, 20 bp, Artificial Sequence
  Description of Artificial Sequence: Synthetic oligonucleotide
tgcctctgctgccatgggct

SEQ ID NO: 4206 - DNA, 20 bp, Artificial Sequence
  Description of Artificial Sequence: Synthetic oligonucleotide
gcctctgctgccatgggctg

SEQ ID NO: 4207 - DNA, 20 bp, Artificial Sequence
  Description of Artificial Sequence: Synthetic oligonucleotide
cctctgctgccatgggctgg

SEQ ID NO: 4208 - DNA, 20 bp, Artificial Sequence
  Description of Artificial Sequence: Synthetic oligonucleotide
ctctgctgccatgggctgga

SEQ ID NO: 4209 - DNA, 20 bp, Artificial Sequence
  Description of Artificial Sequence: Synthetic oligonucleotide
tctgctgccatgggctggat

SEQ ID NO: 4210 - DNA, 20 bp, Artificial Sequence
  Description of Artificial Sequence: Synthetic oligonucleotide
ctgctgccatgggctggatc

SEQ ID NO: 4211 - DNA, 20 bp, Artificial Sequence
  Description of Artificial Sequence: Synthetic oligonucleotide
tgctgccatgggctggatca

SEQ ID NO: 4212 - DNA, 20 bp, Artificial Sequence
  Description of Artificial Sequence: Synthetic oligonucleotide
gctgccatgggctggatcaa

SEQ ID NO: 4213 - DNA, 20 bp, Artificial Sequence
  Description of Artificial Sequence: Synthetic oligonucleotide
ctgccatgggctggatcaac

SEQ ID NO: 4214 - DNA, 20 bp, Artificial Sequence
  Description of Artificial Sequence: Synthetic oligonucleotide
tgccatgggctggatcaaca

SEQ ID NO: 4215 - DNA, 20 bp, Artificial Sequence
  Description of Artificial Sequence: Synthetic oligonucleotide
gccatgggctggatcaacat

SEQ ID NO: 4216 - DNA, 20 bp, Artificial Sequence
  Description of Artificial Sequence: Synthetic oligonucleotide
ccatgggctggatcaacatg

SEQ ID NO: 4217 - DNA, 20 bp, Artificial Sequence
  Description of Artificial Sequence: Synthetic oligonucleotide
catgggctggatcaacatgg

SEQ ID NO: 4218 - DNA, 20 bp, Artificial Sequence
  Description of Artificial Sequence: Synthetic oligonucleotide
atgggctggatcaacatggt

SEQ ID NO: 4219 - DNA, 20 bp, Artificial Sequence
  Description of Artificial Sequence: Synthetic oligonucleotide
tgggctggatcaacatggtg

SEQ ID NO: 4220 - DNA, 20 bp, Artificial Sequence
  Description of Artificial Sequence: Synthetic oligonucleotide
gggctggatcaacatggtgg

SEQ ID NO: 4221 - DNA, 20 bp, Artificial Sequence
  Description of Artificial Sequence: Synthetic oligonucleotide
ggctggatcaacatggtggt

SEQ ID NO: 4222 - DNA, 20 bp, Artificial Sequence
  Description of Artificial Sequence: Synthetic oligonucleotide
gctggatcaacatggtggtg

SEQ ID NO: 4223 - DNA, 20 bp, Artificial Sequence
  Description of Artificial Sequence: Synthetic oligonucleotide
ctggatcaacatggtggtgg

SEQ ID NO: 4224 - DNA, 20 bp, Artificial Sequence
  Description of Artificial Sequence: Synthetic oligonucleotide
tggatcaacatggtggtggc

SEQ ID NO: 4225 - DNA, 20 bp, Artificial Sequence
  Description of Artificial Sequence: Synthetic oligonucleotide
ggatcaacatggtggtggcc

SEQ ID NO: 4226 - DNA, 20 bp, Artificial Sequence
  Description of Artificial Sequence: Synthetic oligonucleotide
gatcaacatggtggtggcct

SEQ ID NO: 4227 - DNA, 20 bp, Artificial Sequence
  Description of Artificial Sequence: Synthetic oligonucleotide
atcaacatggtggtggcctg

SEQ ID NO: 4228 - DNA, 20 bp, Artificial Sequence
  Description of Artificial Sequence: Synthetic oligonucleotide
tcaacatggtggtggcctgc

SEQ ID NO: 4229 - DNA, 20 bp, Artificial Sequence
  Description of Artificial Sequence: Synthetic oligonucleotide
caacatggtggtggcctgca

SEQ ID NO: 4230 - DNA, 20 bp, Artificial Sequence
  Description of Artificial Sequence: Synthetic oligonucleotide
aacatggtggtggcctgcag

SEQ ID NO: 4231 - DNA, 20 bp, Artificial Sequence
  Description of Artificial Sequence: Synthetic oligonucleotide
acatggtggtggcctgcagc

SEQ ID NO: 4232 - DNA, 20 bp, Artificial Sequence
  Description of Artificial Sequence: Synthetic oligonucleotide
catggtggtggcctgcagcg

SEQ ID NO: 4233 - DNA, 20 bp, Artificial Sequence
  Description of Artificial Sequence: Synthetic oligonucleotide
atggtggtggcctgcagcgg

SEQ ID NO: 4234 - DNA, 20 bp, Artificial Sequence
  Description of Artificial Sequence: Synthetic oligonucleotide
tggtggtggcctgcagcggg

SEQ ID NO: 4235 - DNA, 20 bp, Artificial Sequence
  Description of Artificial Sequence: Synthetic oligonucleotide
ggtggtggcctgcagcgggt

SEQ ID NO: 4236 - DNA, 20 bp, Artificial Sequence
  Description of Artificial Sequence: Synthetic oligonucleotide
gtggtggcctgcagcgggta

SEQ ID NO: 4237 - DNA, 20 bp, Artificial Sequence
  Description of Artificial Sequence: Synthetic oligonucleotide
tggtggcctgcagcgggtag

SEQ ID NO: 4238 - DNA, 20 bp, Artificial Sequence
  Description of Artificial Sequence: Synthetic oligonucleotide
ggtggcctgcagcgggtagt

SEQ ID NO: 4239 - DNA, 20 bp, Artificial Sequence
  Description of Artificial Sequence: Synthetic oligonucleotide
gtggcctgcagcgggtagta

SEQ ID NO: 4240 - DNA, 20 bp, Artificial Sequence
  Description of Artificial Sequence: Synthetic oligonucleotide
tggcctgcagcgggtagtag

SEQ ID NO: 4241 - DNA, 20 bp, Artificial Sequence
  Description of Artificial Sequence: Synthetic oligonucleotide
ggcctgcagcgggtagtagc

SEQ ID NO: 4242 - DNA, 20 bp, Artificial Sequence
  Description of Artificial Sequence: Synthetic oligonucleotide
gcctgcagcgggtagtagcg

SEQ ID NO: 4243 - DNA, 20 bp, Artificial Sequence
  Description of Artificial Sequence: Synthetic oligonucleotide
cctgcagcgggtagtagcgg

SEQ ID NO: 4244 - DNA, 20 bp, Artificial Sequence
  Description of Artificial Sequence: Synthetic oligonucleotide
ctgcagcgggtagtagcggc

SEQ ID NO: 4245 - DNA, 20 bp, Artificial Sequence
  Description of Artificial Sequence: Synthetic oligonucleotide
tgcagcgggtagtagcggcc

SEQ ID NO: 4246 - DNA, 20 bp, Artificial Sequence
  Description of Artificial Sequence: Synthetic oligonucleotide
gcagcgggtagtagcggccc

SEQ ID NO: 4247 - DNA, 20 bp, Artificial Sequence
  Description of Artificial Sequence: Synthetic oligonucleotide
cagcgggtagtagcggcccc

SEQ ID NO: 4248 - DNA, 20 bp, Artificial Sequence
  Description of Artificial Sequence: Synthetic oligonucleotide
agcgggtagtagcggccccg

SEQ ID NO: 4249 - DNA, 20 bp, Artificial Sequence
  Description of Artificial Sequence: Synthetic oligonucleotide
gcgggtagtagcggccccgc

SEQ ID NO: 4250 - DNA, 20 bp, Artificial Sequence
  Description of Artificial Sequence: Synthetic oligonucleotide
cgggtagtagcggccccgcc

SEQ ID NO: 4251 - DNA, 20 bp, Artificial Sequence
  Description of Artificial Sequence: Synthetic oligonucleotide
gggtagtagcggccccgcca

SEQ ID NO: 4252 - DNA, 20 bp, Artificial Sequence
  Description of Artificial Sequence: Synthetic oligonucleotide
ggtagtagcggccccgccag

SEQ ID NO: 4253 - DNA, 20 bp, Artificial Sequence
  Description of Artificial Sequence: Synthetic oligonucleotide
gtagtagcggccccgccagg

SEQ ID NO: 4254 - DNA, 20 bp, Artificial Sequence
  Description of Artificial Sequence: Synthetic oligonucleotide
tagtagcggccccgccaggt

SEQ ID NO: 4255 - DNA, 20 bp, Artificial Sequence
  Description of Artificial Sequence: Synthetic oligonucleotide
agtagcggccccgccaggtc

SEQ ID NO: 4256 - DNA, 20 bp, Artificial Sequence
  Description of Artificial Sequence: Synthetic oligonucleotide
gtagcggccccgccaggtct

SEQ ID NO: 4257 - DNA, 20 bp, Artificial Sequence
  Description of Artificial Sequence: Synthetic oligonucleotide
tagcggccccgccaggtctt

SEQ ID NO: 4258 - DNA, 20 bp, Artificial Sequence
  Description of Artificial Sequence: Synthetic oligonucleotide
agcggccccgccaggtcttc

SEQ ID NO: 4259 - DNA, 20 bp, Artificial Sequence
  Description of Artificial Sequence: Synthetic oligonucleotide
gcggccccgccaggtcttcc

SEQ ID NO: 4260 - DNA, 20 bp, Artificial Sequence
  Description of Artificial Sequence: Synthetic oligonucleotide
cggccccgccaggtcttcca

SEQ ID NO: 4261 - DNA, 20 bp, Artificial Sequence
  Description of Artificial Sequence: Synthetic oligonucleotide
ggccccgccaggtcttccag

SEQ ID NO: 4262 - DNA, 20 bp, Artificial Sequence
  Description of Artificial Sequence: Synthetic oligonucleotide
gccccgccaggtcttccaga

SEQ ID NO: 4263 - DNA, 20 bp, Artificial Sequence
  Description of Artificial Sequence: Synthetic oligonucleotide
ccccgccaggtcttccagaa

SEQ ID NO: 4264 - DNA, 20 bp, Artificial Sequence
  Description of Artificial Sequence: Synthetic oligonucleotide
cccgccaggtcttccagaag

SEQ ID NO: 4265 - DNA, 20 bp, Artificial Sequence
  Description of Artificial Sequence: Synthetic oligonucleotide
ccgccaggtcttccagaaga

SEQ ID NO: 4266 - DNA, 20 bp, Artificial Sequence
  Description of Artificial Sequence: Synthetic oligonucleotide
cgccaggtcttccagaagat

SEQ ID NO: 4267 - DNA, 20 bp, Artificial Sequence
  Description of Artificial Sequence: Synthetic oligonucleotide
gccaggtcttccagaagatt

SEQ ID NO: 4268 - DNA, 20 bp, Artificial Sequence
  Description of Artificial Sequence: Synthetic oligonucleotide
ccaggtcttccagaagattc

SEQ ID NO: 4269 - DNA, 20 bp, Artificial Sequence
  Description of Artificial Sequence: Synthetic oligonucleotide
caggtcttccagaagattcc

SEQ ID NO: 4270 - DNA, 20 bp, Artificial Sequence
  Description of Artificial Sequence: Synthetic oligonucleotide
aggtcttccagaagattccc

SEQ ID NO: 4271 - DNA, 20 bp, Artificial Sequence
  Description of Artificial Sequence: Synthetic oligonucleotide
ggtcttccagaagattccct

SEQ ID NO: 4272 - DNA, 20 bp, Artificial Sequence
  Description of Artificial Sequence: Synthetic oligonucleotide
gtcttccagaagattccctt

SEQ ID NO: 4273 - DNA, 20 bp, Artificial Sequence
  Description of Artificial Sequence: Synthetic oligonucleotide
tcttccagaagattcccttc

SEQ ID NO: 4274 - DNA, 20 bp, Artificial Sequence
  Description of Artificial Sequence: Synthetic oligonucleotide
cttccagaagattcccttct

SEQ ID NO: 4275 - DNA, 20 bp, Artificial Sequence
  Description of Artificial Sequence: Synthetic oligonucleotide
ttccagaagattcccttctt

SEQ ID NO: 4276 - DNA, 20 bp, Artificial Sequence
  Description of Artificial Sequence: Synthetic oligonucleotide
tccagaagattcccttctta

SEQ ID NO: 4277 - DNA, 20 bp, Artificial Sequence
  Description of Artificial Sequence: Synthetic oligonucleotide
ccagaagattcccttcttaa

SEQ ID NO: 4278 - DNA, 20 bp, Artificial Sequence
  Description of Artificial Sequence: Synthetic oligonucleotide
cagaagattcccttcttaag

SEQ ID NO: 4279 - DNA, 20 bp, Artificial Sequence
  Description of Artificial Sequence: Synthetic oligonucleotide
agaagattcccttcttaagc

SEQ ID NO: 4280 - DNA, 20 bp, Artificial Sequence
  Description of Artificial Sequence: Synthetic oligonucleotide
gaagattcccttcttaagct

SEQ ID NO: 4281 - DNA, 20 bp, Artificial Sequence
  Description of Artificial Sequence: Synthetic oligonucleotide
aagattcccttcttaagctt

SEQ ID NO: 4282 - DNA, 20 bp, Artificial Sequence
  Description of Artificial Sequence: Synthetic oligonucleotide
agattcccttcttaagcttc

SEQ ID NO: 4283 - DNA, 20 bp, Artificial Sequence
  Description of Artificial Sequence: Synthetic oligonucleotide
gattcccttcttaagcttct

SEQ ID NO: 4284 - DNA, 20 bp, Artificial Sequence
  Description of Artificial Sequence: Synthetic oligonucleotide
attcccttcttaagcttctg

SEQ ID NO: 4285 - DNA, 20 bp, Artificial Sequence
  Description of Artificial Sequence: Synthetic oligonucleotide
ttcccttcttaagcttctgc

SEQ ID NO: 4286 - DNA, 20 bp, Artificial Sequence
  Description of Artificial Sequence: Synthetic oligonucleotide
tcccttcttaagcttctgcc

SEQ ID NO: 4287 - DNA, 20 bp, Artificial Sequence
  Description of Artificial Sequence: Synthetic oligonucleotide
cccttcttaagcttctgccg

SEQ ID NO: 4288 - DNA, 20 bp, Artificial Sequence
  Description of Artificial Sequence: Synthetic oligonucleotide
ccttcttaagcttctgccgc

SEQ ID NO: 4289 - DNA, 20 bp, Artificial Sequence
  Description of Artificial Sequence: Synthetic oligonucleotide
cttcttaagcttctgccgct

SEQ ID NO: 4290 - DNA, 20 bp, Artificial Sequence
  Description of Artificial Sequence: Synthetic oligonucleotide
ttcttaagcttctgccgctg

SEQ ID NO: 4291 - DNA, 20 bp, Artificial Sequence
  Description of Artificial Sequence: Synthetic oligonucleotide
tcttaagcttctgccgctgc

SEQ ID NO: 4292 - DNA, 20 bp, Artificial Sequence
  Description of Artificial Sequence: Synthetic oligonucleotide
cttaagcttctgccgctgct

SEQ ID NO: 4293 - DNA, 20 bp, Artificial Sequence
  Description of Artificial Sequence: Synthetic oligonucleotide
ttaagcttctgccgctgctg

SEQ ID NO: 4294 - DNA, 20 bp, Artificial Sequence
  Description of Artificial Sequence: Synthetic oligonucleotide
taagcttctgccgctgctgt

SEQ ID NO: 4295 - DNA, 20 bp, Artificial Sequence
  Description of Artificial Sequence: Synthetic oligonucleotide
aagcttctgccgctgctgtg

SEQ ID NO: 4296 - DNA, 20 bp, Artificial Sequence
  Description of Artificial Sequence: Synthetic oligonucleotide
agcttctgccgctgctgtgg

SEQ ID NO: 4297 - DNA, 20 bp, Artificial Sequence
  Description of Artificial Sequence: Synthetic oligonucleotide
gcttctgccgctgctgtggg

SEQ ID NO: 4298 - DNA, 20 bp, Artificial Sequence
  Description of Artificial Sequence: Synthetic oligonucleotide
cttctgccgctgctgtggga

SEQ ID NO: 4299 - DNA, 20 bp, Artificial Sequence
  Description of Artificial Sequence: Synthetic oligonucleotide
ttctgccgctgctgtgggat

SEQ ID NO: 4300 - DNA, 20 bp, Artificial Sequence
  Description of Artificial Sequence: Synthetic oligonucleotide
tctgccgctgctgtgggatg

SEQ ID NO: 4301 - DNA, 20 bp, Artificial Sequence
  Description of Artificial Sequence: Synthetic oligonucleotide
ctgccgctgctgtgggatgg

SEQ ID NO: 4302 - DNA, 20 bp, Artificial Sequence
  Description of Artificial Sequence: Synthetic oligonucleotide
tgccgctgctgtgggatgga

SEQ ID NO: 4303 - DNA, 20 bp, Artificial Sequence
  Description of Artificial Sequence: Synthetic oligonucleotide
gccgctgctgtgggatggag

SEQ ID NO: 4304 - DNA, 20 bp, Artificial Sequence
  Description of Artificial Sequence: Synthetic oligonucleotide
ccgctgctgtgggatggagc

SEQ ID NO: 4305 - DNA, 20 bp, Artificial Sequence
  Description of Artificial Sequence: Synthetic oligonucleotide
cgctgctgtgggatggagcg

SEQ ID NO: 4306 - DNA, 20 bp, Artificial Sequence
  Description of Artificial Sequence: Synthetic oligonucleotide
gctgctgtgggatggagcgg

SEQ ID NO: 4307 - DNA, 20 bp, Artificial Sequence
  Description of Artificial Sequence: Synthetic oligonucleotide
ctgctgtgggatggagcgga

SEQ ID NO: 4308 - DNA, 20 bp, Artificial Sequence
  Description of Artificial Sequence: Synthetic oligonucleotide
tgctgtgggatggagcggaa

SEQ ID NO: 4309 - DNA, 20 bp, Artificial Sequence
  Description of Artificial Sequence: Synthetic oligonucleotide
gctgtgggatggagcggaag

SEQ ID NO: 4310 - DNA, 20 bp, Artificial Sequence
  Description of Artificial Sequence: Synthetic oligonucleotide
ctgtgggatggagcggaagt

SEQ ID NO: 4311 - DNA, 20 bp, Artificial Sequence
  Description of Artificial Sequence: Synthetic oligonucleotide
tgtgggatggagcggaagta

SEQ ID NO: 4312 - DNA, 20 bp, Artificial Sequence
  Description of Artificial Sequence: Synthetic oligonucleotide
gtgggatggagcggaagtac

SEQ ID NO: 4313 - DNA, 20 bp, Artificial Sequence
  Description of Artificial Sequence: Synthetic oligonucleotide
tgggatggagcggaagtact

SEQ ID NO: 4314 - DNA, 20 bp, Artificial Sequence
  Description of Artificial Sequence: Synthetic oligonucleotide
gggatggagcggaagtactg

SEQ ID NO: 4315 - DNA, 20 bp, Artificial Sequence
  Description of Artificial Sequence: Synthetic oligonucleotide
ggatggagcggaagtactgg

SEQ ID NO: 4316 - DNA, 20 bp, Artificial Sequence
  Description of Artificial Sequence: Synthetic oligonucleotide
gatggagcggaagtactggc

SEQ ID NO: 4317 - DNA, 20 bp, Artificial Sequence
  Description of Artificial Sequence: Synthetic oligonucleotide
atggagcggaagtactggcc

SEQ ID NO: 4318 - DNA, 20 bp, Artificial Sequence
  Description of Artificial Sequence: Synthetic oligonucleotide
tggagcggaagtactggccg

SEQ ID NO: 4319 - DNA, 20 bp, Artificial Sequence
  Description of Artificial Sequence: Synthetic oligonucleotide
ggagcggaagtactggccgt

SEQ ID NO: 4320 - DNA, 20 bp, Artificial Sequence
  Description of Artificial Sequence: Synthetic oligonucleotide
gagcggaagtactggccgtt

SEQ ID NO: 4321 - DNA, 20 bp, Artificial Sequence
  Description of Artificial Sequence: Synthetic oligonucleotide
agcggaagtactggccgttg

SEQ ID NO: 4322 - DNA, 20 bp, Artificial Sequence
  Description of Artificial Sequence: Synthetic oligonucleotide
gcggaagtactggccgttga

SEQ ID NO: 4323 - DNA, 20 bp, Artificial Sequence
  Description of Artificial Sequence: Synthetic oligonucleotide
cggaagtactggccgttgag

SEQ ID NO: 4324 - DNA, 20 bp, Artificial Sequence
  Description of Artificial Sequence: Synthetic oligonucleotide
ggaagtactggccgttgagg

SEQ ID NO: 4325 - DNA, 20 bp, Artificial Sequence
  Description of Artificial Sequence: Synthetic oligonucleotide
gaagtactggccgttgaggt

SEQ ID NO: 4326 - DNA, 20 bp, Artificial Sequence
  Description of Artificial Sequence: Synthetic oligonucleotide
aagtactggccgttgaggtt

SEQ ID NO: 4327 - DNA, 20 bp, Artificial Sequence
  Description of Artificial Sequence: Synthetic oligonucleotide
agtactggccgttgaggttg

SEQ ID NO: 4328 - DNA, 20 bp, Artificial Sequence
  Description of Artificial Sequence: Synthetic oligonucleotide
gtactggccgttgaggttgg

SEQ ID NO: 4329 - DNA, 20 bp, Artificial Sequence
  Description of Artificial Sequence: Synthetic oligonucleotide
tactggccgttgaggttgga

SEQ ID NO: 4330 - DNA, 20 bp, Artificial Sequence
  Description of Artificial Sequence: Synthetic oligonucleotide
actggccgttgaggttggaa

SEQ ID NO: 4331 - DNA, 20 bp, Artificial Sequence
  Description of Artificial Sequence: Synthetic oligonucleotide
ctggccgttgaggttggaat

SEQ ID NO: 4332 - DNA, 20 bp, Artificial Sequence
  Description of Artificial Sequence: Synthetic oligonucleotide
tggccgttgaggttggaatg

SEQ ID NO: 4333 - DNA, 20 bp, Artificial Sequence
  Description of Artificial Sequence: Synthetic oligonucleotide
ggccgttgaggttggaatgg

SEQ ID NO: 4334 - DNA, 20 bp, Artificial Sequence
  Description of Artificial Sequence: Synthetic oligonucleotide
gccgttgaggttggaatggc

SEQ ID NO: 4335 - DNA, 20 bp, Artificial Sequence
  Description of Artificial Sequence: Synthetic oligonucleotide
ccgttgaggttggaatggct

SEQ ID NO: 4336 - DNA, 20 bp, Artificial Sequence
  Description of Artificial Sequence: Synthetic oligonucleotide
cgttgaggttggaatggctg

SEQ ID NO: 4337 - DNA, 20 bp, Artificial Sequence
  Description of Artificial Sequence: Synthetic oligonucleotide
gttgaggttggaatggctgc

SEQ ID NO: 4338 - DNA, 20 bp, Artificial Sequence
  Description of Artificial Sequence: Synthetic oligonucleotide
ttgaggttggaatggctgca

SEQ ID NO: 4339 - DNA, 20 bp, Artificial Sequence
  Description of Artificial Sequence: Synthetic oligonucleotide
tgaggttggaatggctgcag

SEQ ID NO: 4340 - DNA, 20 bp, Artificial Sequence
  Description of Artificial Sequence: Synthetic oligonucleotide
gaggttggaatggctgcagg

SEQ ID NO: 4341 - DNA, 20 bp, Artificial Sequence
  Description of Artificial Sequence: Synthetic oligonucleotide
aggttggaatggctgcaggt

SEQ ID NO: 4342 - DNA, 20 bp, Artificial Sequence
  Description of Artificial Sequence: Synthetic oligonucleotide
ggttggaatggctgcaggtg

SEQ ID NO: 4343 - DNA, 20 bp, Artificial Sequence
  Description of Artificial Sequence: Synthetic oligonucleotide
gttggaatggctgcaggtgc

SEQ ID NO: 4344 - DNA, 20 bp, Artificial Sequence
  Description of Artificial Sequence: Synthetic oligonucleotide
ttggaatggctgcaggtgcc

SEQ ID NO: 4345 - DNA, 20 bp, Artificial Sequence
  Description of Artificial Sequence: Synthetic oligonucleotide
tggaatggctgcaggtgcca

SEQ ID NO: 4346 - DNA, 20 bp, Artificial Sequence
  Description of Artificial Sequence: Synthetic oligonucleotide
ggaatggctgcaggtgccaa

SEQ ID NO: 4347 - DNA, 20 bp, Artificial Sequence
  Description of Artificial Sequence: Synthetic oligonucleotide
gaatggctgcaggtgccaaa

SEQ ID NO: 4348 - DNA, 20 bp, Artificial Sequence
  Description of Artificial Sequence: Synthetic oligonucleotide
aatggctgcaggtgccaaac

SEQ ID NO: 4349 - DNA, 20 bp, Artificial Sequence
  Description of Artificial Sequence: Synthetic oligonucleotide
atggctgcaggtgccaaacc

SEQ ID NO: 4350 - DNA, 20 bp, Artificial Sequence
  Description of Artificial Sequence: Synthetic oligonucleotide
tggctgcaggtgccaaacca

SEQ ID NO: 4351 - DNA, 20 bp, Artificial Sequence
  Description of Artificial Sequence: Synthetic oligonucleotide
ggctgcaggtgccaaaccac

SEQ ID NO: 4352 - DNA, 20 bp, Artificial Sequence
  Description of Artificial Sequence: Synthetic oligonucleotide
gctgcaggtgccaaaccacc

SEQ ID NO: 4353 - DNA, 20 bp, Artificial Sequence
  Description of Artificial Sequence: Synthetic oligonucleotide
ctgcaggtgccaaaccacca

SEQ ID NO: 4354 - DNA, 20 bp, Artificial Sequence
  Description of Artificial Sequence: Synthetic oligonucleotide
tgcaggtgccaaaccaccag

SEQ ID NO: 4355 - DNA, 20 bp, Artificial Sequence
  Description of Artificial Sequence: Synthetic oligonucleotide
gcaggtgccaaaccaccagc

SEQ ID NO: 4356 - DNA, 20 bp, Artificial Sequence
  Description of Artificial Sequence: Synthetic oligonucleotide
caggtgccaaaccaccagcc

SEQ ID NO: 4357 - DNA, 20 bp, Artificial Sequence
  Description of Artificial Sequence: Synthetic oligonucleotide
aggtgccaaaccaccagcct

SEQ ID NO: 4358 - DNA, 20 bp, Artificial Sequence
  Description of Artificial Sequence: Synthetic oligonucleotide
ggtgccaaaccaccagcctc

SEQ ID NO: 4359 - DNA, 20 bp, Artificial Sequence
  Description of Artificial Sequence: Synthetic oligonucleotide
gtgccaaaccaccagcctcc

SEQ ID NO: 4360 - DNA, 20 bp, Artificial Sequence
  Description of Artificial Sequence: Synthetic oligonucleotide
tgccaaaccaccagcctcct

SEQ ID NO: 4361 - DNA, 20 bp, Artificial Sequence
  Description of Artificial Sequence: Synthetic oligonucleotide
gccaaaccaccagcctcctg

SEQ ID NO: 4362 - DNA, 20 bp, Artificial Sequence
  Description of Artificial Sequence: Synthetic oligonucleotide
ccaaaccaccagcctcctgc

SEQ ID NO: 4363 - DNA, 20 bp, Artificial Sequence
  Description of Artificial Sequence: Synthetic oligonucleotide
caaaccaccagcctcctgcc

SEQ ID NO: 4364 - DNA, 20 bp, Artificial Sequence
  Description of Artificial Sequence: Synthetic oligonucleotide
aaaccaccagcctcctgccg

SEQ ID NO: 4365 - DNA, 20 bp, Artificial Sequence
  Description of Artificial Sequence: Synthetic oligonucleotide
aaccaccagcctcctgccgg

SEQ ID NO: 4366 - DNA, 20 bp, Artificial Sequence
  Description of Artificial Sequence: Synthetic oligonucleotide
accaccagcctcctgccggg

SEQ ID NO: 4367 - DNA, 20 bp, Artificial Sequence
  Description of Artificial Sequence: Synthetic oligonucleotide
ccaccagcctcctgccgggg

SEQ ID NO: 4368 - DNA, 20 bp, Artificial Sequence
  Description of Artificial Sequence: Synthetic oligonucleotide
caccagcctcctgccggggt

SEQ ID NO: 4369 - DNA, 20 bp, Artificial Sequence
  Description of Artificial Sequence: Synthetic oligonucleotide
accagcctcctgccggggtc

SEQ ID NO: 4370 - DNA, 20 bp, Artificial Sequence
  Description of Artificial Sequence: Synthetic oligonucleotide
ccagcctcctgccggggtca

SEQ ID NO: 4371 - DNA, 20 bp, Artificial Sequence
  Description of Artificial Sequence: Synthetic oligonucleotide
cagcctcctgccggggtcag

SEQ ID NO: 4372 - DNA, 20 bp, Artificial Sequence
  Description of Artificial Sequence: Synthetic oligonucleotide
agcctcctgccggggtcagg

SEQ ID NO: 4373 - DNA, 20 bp, Artificial Sequence
  Description of Artificial Sequence: Synthetic oligonucleotide
gcctcctgccggggtcaggg

SEQ ID NO: 4374 - DNA, 20 bp, Artificial Sequence
  Description of Artificial Sequence: Synthetic oligonucleotide
cctcctgccggggtcagggg

SEQ ID NO: 4375 - DNA, 20 bp, Artificial Sequence
  Description of Artificial Sequence: Synthetic oligonucleotide
ctcctgccggggtcagggga

SEQ ID NO: 4376 - DNA, 20 bp, Artificial Sequence
  Description of Artificial Sequence: Synthetic oligonucleotide
tcctgccggggtcaggggag

SEQ ID NO: 4377 - DNA, 20 bp, Artificial Sequence
  Description of Artificial Sequence: Synthetic oligonucleotide
cctgccggggtcaggggaga

SEQ ID NO: 4378 - DNA, 20 bp, Artificial Sequence
  Description of Artificial Sequence: Synthetic oligonucleotide
ctgccggggtcaggggagag

SEQ ID NO: 4379 - DNA, 20 bp, Artificial Sequence
  Description of Artificial Sequence: Synthetic oligonucleotide
tgccggggtcaggggagagg

SEQ ID NO: 4380 - DNA, 20 bp, Artificial Sequence
  Description of Artificial Sequence: Synthetic oligonucleotide
gccggggtcaggggagaggg

SEQ ID NO: 4381 - DNA, 20 bp, Artificial Sequence
  Description of Artificial Sequence: Synthetic oligonucleotide
ccggggtcaggggagaggga

SEQ ID NO: 4382 - DNA, 20 bp, Artificial Sequence
  Description of Artificial Sequence: Synthetic oligonucleotide
cggggtcaggggagagggaa

SEQ ID NO: 4383 - DNA, 20 bp, Artificial Sequence
  Description of Artificial Sequence: Synthetic oligonucleotide
ggggtcaggggagagggaac

SEQ ID NO: 4384 - DNA, 20 bp, Artificial Sequence
  Description of Artificial Sequence: Synthetic oligonucleotide
gggtcaggggagagggaaca

SEQ ID NO: 4385 - DNA, 20 bp, Artificial Sequence
  Description of Artificial Sequence: Synthetic oligonucleotide
ggtcaggggagagggaacat

SEQ ID NO: 4386 - DNA, 20 bp, Artificial Sequence
  Description of Artificial Sequence: Synthetic oligonucleotide
gtcaggggagagggaacatg

SEQ ID NO: 4387 - DNA, 20 bp, Artificial Sequence
  Description of Artificial Sequence: Synthetic oligonucleotide
tcaggggagagggaacatgg

SEQ ID NO: 4388 - DNA, 20 bp, Artificial Sequence
  Description of Artificial Sequence: Synthetic oligonucleotide
caggggagagggaacatggt

SEQ ID NO: 4389 - DNA, 20 bp, Artificial Sequence
  Description of Artificial Sequence: Synthetic oligonucleotide
aggggagagggaacatggtc

SEQ ID NO: 4390 - DNA, 20 bp, Artificial Sequence
  Description of Artificial Sequence: Synthetic oligonucleotide
ggggagagggaacatggtca

SEQ ID NO: 4391 - DNA, 20 bp, Artificial Sequence
  Description of Artificial Sequence: Synthetic oligonucleotide
gggagagggaacatggtcag

SEQ ID NO: 4392 - DNA, 20 bp, Artificial Sequence
  Description of Artificial Sequence: Synthetic oligonucleotide
ggagagggaacatggtcagg

SEQ ID NO: 4393 - DNA, 20 bp, Artificial Sequence
  Description of Artificial Sequence: Synthetic oligonucleotide
gagagggaacatggtcaggt

SEQ ID NO: 4394 - DNA, 20 bp, Artificial Sequence
  Description of Artificial Sequence: Synthetic oligonucleotide
agagggaacatggtcaggtc

SEQ ID NO: 4395 - DNA, 20 bp, Artificial Sequence
  Description of Artificial Sequence: Synthetic oligonucleotide
gagggaacatggtcaggtct

SEQ ID NO: 4396 - DNA, 20 bp, Artificial Sequence
  Description of Artificial Sequence: Synthetic oligonucleotide
agggaacatggtcaggtctt

SEQ ID NO: 4397 - DNA, 20 bp, Artificial Sequence
  Description of Artificial Sequence: Synthetic oligonucleotide
gggaacatggtcaggtcttt

SEQ ID NO: 4398 - DNA, 20 bp, Artificial Sequence
  Description of Artificial Sequence: Synthetic oligonucleotide
ggaacatggtcaggtctttg

SEQ ID NO: 4399 - DNA, 20 bp, Artificial Sequence
  Description of Artificial Sequence: Synthetic oligonucleotide
gaacatggtcaggtctttga

SEQ ID NO: 4400 - DNA, 20 bp, Artificial Sequence
  Description of Artificial Sequence: Synthetic oligonucleotide
aacatggtcaggtctttgag

SEQ ID NO: 4401 - DNA, 20 bp, Artificial Sequence
  Description of Artificial Sequence: Synthetic oligonucleotide
acatggtcaggtctttgagc

SEQ ID NO: 4402 - DNA, 20 bp, Artificial Sequence
  Description of Artificial Sequence: Synthetic oligonucleotide
catggtcaggtctttgagcc

SEQ ID NO: 4403 - DNA, 20 bp, Artificial Sequence
  Description of Artificial Sequence: Synthetic oligonucleotide
atggtcaggtctttgagcca

SEQ ID NO: 4404 - DNA, 20 bp, Artificial Sequence
  Description of Artificial Sequence: Synthetic oligonucleotide
tggtcaggtctttgagccac

SEQ ID NO: 4405 - DNA, 20 bp, Artificial Sequence
  Description of Artificial Sequence: Synthetic oligonucleotide
ggtcaggtctttgagccacc

SEQ ID NO: 4406 - DNA, 20 bp, Artificial Sequence
  Description of Artificial Sequence: Synthetic oligonucleotide
gtcaggtctttgagccaccg

SEQ ID NO: 4407 - DNA, 20 bp, Artificial Sequence
  Description of Artificial Sequence: Synthetic oligonucleotide
tcaggtctttgagccaccga

SEQ ID NO: 4408 - DNA, 20 bp, Artificial Sequence
  Description of Artificial Sequence: Synthetic oligonucleotide
caggtctttgagccaccgat

SEQ ID NO: 4409 - DNA, 20 bp, Artificial Sequence
  Description of Artificial Sequence: Synthetic oligonucleotide
aggtctttgagccaccgatg

SEQ ID NO: 4410 - DNA, 20 bp, Artificial Sequence
  Description of Artificial Sequence: Synthetic oligonucleotide
ggtctttgagccaccgatgg

SEQ ID NO: 4411 - DNA, 20 bp, Artificial Sequence
  Description of Artificial Sequence: Synthetic oligonucleotide
gtctttgagccaccgatggg

SEQ ID NO: 4412 - DNA, 20 bp, Artificial Sequence
  Description of Artificial Sequence: Synthetic oligonucleotide
tctttgagccaccgatgggg

SEQ ID NO: 4413 - DNA, 20 bp, Artificial Sequence
  Description of Artificial Sequence: Synthetic oligonucleotide
ctttgagccaccgatggggc

SEQ ID NO: 4414 - DNA, 20 bp, Artificial Sequence
  Description of Artificial Sequence: Synthetic oligonucleotide
tttgagccaccgatggggct

SEQ ID NO: 4415 - DNA, 20 bp, Artificial Sequence
  Description of Artificial Sequence: Synthetic oligonucleotide
ttgagccaccgatggggctg

SEQ ID NO: 4416 - DNA, 20 bp, Artificial Sequence
  Description of Artificial Sequence: Synthetic oligonucleotide
tgagccaccgatggggctga

SEQ ID NO: 4417 - DNA, 20 bp, Artificial Sequence
  Description of Artificial Sequence: Synthetic oligonucleotide
gagccaccgatggggctgaa

SEQ ID NO: 4418 - DNA, 20 bp, Artificial Sequence
  Description of Artificial Sequence: Synthetic oligonucleotide
agccaccgatggggctgaaa

SEQ ID NO: 4419 - DNA, 20 bp, Artificial Sequence
  Description of Artificial Sequence: Synthetic oligonucleotide
gccaccgatggggctgaaag

SEQ ID NO: 4420 - DNA, 20 bp, Artificial Sequence
  Description of Artificial Sequence: Synthetic oligonucleotide
ccaccgatggggctgaaagg

SEQ ID NO: 4421 - DNA, 20 bp, Artificial Sequence
  Description of Artificial Sequence: Synthetic oligonucleotide
caccgatggggctgaaagga

SEQ ID NO: 4422 - DNA, 20 bp, Artificial Sequence
  Description of Artificial Sequence: Synthetic oligonucleotide
accgatggggctgaaaggag

SEQ ID NO: 4423 - DNA, 20 bp, Artificial Sequence
  Description of Artificial Sequence: Synthetic oligonucleotide
ccgatggggctgaaaggaga

SEQ ID NO: 4424 - DNA, 20 bp, Artificial Sequence
  Description of Artificial Sequence: Synthetic oligonucleotide
cgatggggctgaaaggagat

SEQ ID NO: 4425 - DNA, 20 bp, Artificial Sequence
  Description of Artificial Sequence: Synthetic oligonucleotide
gatggggctgaaaggagata

SEQ ID NO: 4426 - DNA, 20 bp, Artificial Sequence
  Description of Artificial Sequence: Synthetic oligonucleotide
atggggctgaaaggagatag

SEQ ID NO: 4427 - DNA, 20 bp, Artificial Sequence
  Description of Artificial Sequence: Synthetic oligonucleotide
tggggctgaaaggagatagg

SEQ ID NO: 4428 - DNA, 20 bp, Artificial Sequence
  Description of Artificial Sequence: Synthetic oligonucleotide
ggggctgaaaggagataggg

SEQ ID NO: 4429 - DNA, 20 bp, Artificial Sequence
  Description of Artificial Sequence: Synthetic oligonucleotide
gggctgaaaggagataggga

SEQ ID NO: 4430 - DNA, 20 bp, Artificial Sequence
  Description of Artificial Sequence: Synthetic oligonucleotide
ggctgaaaggagatagggat

SEQ ID NO: 4431 - DNA, 20 bp, Artificial Sequence
  Description of Artificial Sequence: Synthetic oligonucleotide
gctgaaaggagatagggata

SEQ ID NO: 4432 - DNA, 20 bp, Artificial Sequence
  Description of Artificial Sequence: Synthetic oligonucleotide
ctgaaaggagatagggatag

SEQ ID NO: 4433 - DNA, 20 bp, Artificial Sequence
  Description of Artificial Sequence: Synthetic oligonucleotide
tgaaaggagatagggatagg

SEQ ID NO: 4434 - DNA, 20 bp, Artificial Sequence
  Description of Artificial Sequence: Synthetic oligonucleotide
gaaaggagatagggataggg

SEQ ID NO: 4435 - DNA, 20 bp, Artificial Sequence
  Description of Artificial Sequence: Synthetic oligonucleotide
aaaggagatagggatagggt

SEQ ID NO: 4436 - DNA, 20 bp, Artificial Sequence
  Description of Artificial Sequence: Synthetic oligonucleotide
aaggagatagggatagggtt

SEQ ID NO: 4437 - DNA, 20 bp, Artificial Sequence
  Description of Artificial Sequence: Synthetic oligonucleotide
aggagatagggatagggttg

SEQ ID NO: 4438 - DNA, 20 bp, Artificial Sequence
  Description of Artificial Sequence: Synthetic oligonucleotide
ggagatagggatagggttga

SEQ ID NO: 4439 - DNA, 20 bp, Artificial Sequence
  Description of Artificial Sequence: Synthetic oligonucleotide
gagatagggatagggttgag

SEQ ID NO: 4440 - DNA, 20 bp, Artificial Sequence
  Description of Artificial Sequence: Synthetic oligonucleotide
agatagggatagggttgagg

SEQ ID NO: 4441 - DNA, 20 bp, Artificial Sequence
  Description of Artificial Sequence: Synthetic oligonucleotide
gatagggatagggttgagga

SEQ ID NO: 4442 - DNA, 20 bp, Artificial Sequence
  Description of Artificial Sequence: Synthetic oligonucleotide
atagggatagggttgaggat

SEQ ID NO: 4443 - DNA, 20 bp, Artificial Sequence
  Description of Artificial Sequence: Synthetic oligonucleotide
tagggatagggttgaggatg

SEQ ID NO: 4444 - DNA, 20 bp, Artificial Sequence
  Description of Artificial Sequence: Synthetic oligonucleotide
agggatagggttgaggatga

SEQ ID NO: 4445 - DNA, 20 bp, Artificial Sequence
  Description of Artificial Sequence: Synthetic oligonucleotide
gggatagggttgaggatgag

SEQ ID NO: 4446 - DNA, 20 bp, Artificial Sequence
  Description of Artificial Sequence: Synthetic oligonucleotide
ggatagggttgaggatgagg

SEQ ID NO: 4447 - DNA, 20 bp, Artificial Sequence
  Description of Artificial Sequence: Synthetic oligonucleotide
gatagggttgaggatgaggc

SEQ ID NO: 4448 - DNA, 20 bp, Artificial Sequence
  Description of Artificial Sequence: Synthetic oligonucleotide
atagggttgaggatgaggca

SEQ ID NO: 4449 - DNA, 20 bp, Artificial Sequence
  Description of Artificial Sequence: Synthetic oligonucleotide
tagggttgaggatgaggcag

SEQ ID NO: 4450 - DNA, 20 bp, Artificial Sequence
  Description of Artificial Sequence: Synthetic oligonucleotide
agggttgaggatgaggcagg

SEQ ID NO: 4451 - DNA, 20 bp, Artificial Sequence
  Description of Artificial Sequence: Synthetic oligonucleotide
gggttgaggatgaggcaggt

SEQ ID NO: 4452 - DNA, 20 bp, Artificial Sequence
  Description of Artificial Sequence: Synthetic oligonucleotide
ggttgaggatgaggcaggtt

SEQ ID NO: 4453 - DNA, 20 bp, Artificial Sequence
  Description of Artificial Sequence: Synthetic oligonucleotide
gttgaggatgaggcaggttg

SEQ ID NO: 4454 - DNA, 20 bp, Artificial Sequence
  Description of Artificial Sequence: Synthetic oligonucleotide
ttgaggatgaggcaggttgg

SEQ ID NO: 4455 - DNA, 20 bp, Artificial Sequence
  Description of Artificial Sequence: Synthetic oligonucleotide
tgaggatgaggcaggttggg

SEQ ID NO: 4456 - DNA, 20 bp, Artificial Sequence
  Description of Artificial Sequence: Synthetic oligonucleotide
gaggatgaggcaggttgggg

SEQ ID NO: 4457 - DNA, 20 bp, Artificial Sequence
  Description of Artificial Sequence: Synthetic oligonucleotide
aggatgaggcaggttgggga

SEQ ID NO: 4458 - DNA, 20 bp, Artificial Sequence
  Description of Artificial Sequence: Synthetic oligonucleotide
ggatgaggcaggttggggac

SEQ ID NO: 4459 - DNA, 20 bp, Artificial Sequence
  Description of Artificial Sequence: Synthetic oligonucleotide
gatgaggcaggttggggacc

SEQ ID NO: 4460 - DNA, 20 bp, Artificial Sequence
  Description of Artificial Sequence: Synthetic oligonucleotide
atgaggcaggttggggacca

SEQ ID NO: 4461 - DNA, 20 bp, Artificial Sequence
  Description of Artificial Sequence: Synthetic oligonucleotide
tgaggcaggttggggaccag

SEQ ID NO: 4462 - DNA, 20 bp, Artificial Sequence
  Description of Artificial Sequence: Synthetic oligonucleotide
gaggcaggttggggaccagg

SEQ ID NO: 4463 - DNA, 20 bp, Artificial Sequence
  Description of Artificial Sequence: Synthetic oligonucleotide
aggcaggttggggaccaggc

SEQ ID NO: 4464 - DNA, 20 bp, Artificial Sequence
  Description of Artificial Sequence: Synthetic oligonucleotide
ggcaggttggggaccaggct

SEQ ID NO: 4465 - DNA, 20 bp, Artificial Sequence
  Description of Artificial Sequence: Synthetic oligonucleotide
gcaggttggggaccaggctg

SEQ ID NO: 4466 - DNA, 20 bp, Artificial Sequence
  Description of Artificial Sequence: Synthetic oligonucleotide
caggttggggaccaggctgg

SEQ ID NO: 4467 - DNA, 20 bp, Artificial Sequence
  Description of Artificial Sequence: Synthetic oligonucleotide
aggttggggaccaggctggg

SEQ ID NO: 4468 - DNA, 20 bp, Artificial Sequence
  Description of Artificial Sequence: Synthetic oligonucleotide
ggttggggaccaggctgggc

SEQ ID NO: 4469 - DNA, 20 bp, Artificial Sequence
  Description of Artificial Sequence: Synthetic oligonucleotide
gttggggaccaggctgggct

SEQ ID NO: 4470 - DNA, 20 bp, Artificial Sequence
  Description of Artificial Sequence: Synthetic oligonucleotide
ttggggaccaggctgggctt

SEQ ID NO: 4471 - DNA, 20 bp, Artificial Sequence
  Description of Artificial Sequence: Synthetic oligonucleotide
tggggaccaggctgggcttt

SEQ ID NO: 4472 - DNA, 20 bp, Artificial Sequence
  Description of Artificial Sequence: Synthetic oligonucleotide
ggggaccaggctgggctttg

SEQ ID NO: 4473 - DNA, 20 bp, Artificial Sequence
  Description of Artificial Sequence: Synthetic oligonucleotide
gggaccaggctgggctttgg

SEQ ID NO: 4474 - DNA, 20 bp, Artificial Sequence
  Description of Artificial Sequence: Synthetic oligonucleotide
ggaccaggctgggctttgga

SEQ ID NO: 4475 - DNA, 20 bp, Artificial Sequence
  Description of Artificial Sequence: Synthetic oligonucleotide
gaccaggctgggctttggac

SEQ ID NO: 4476 - DNA, 20 bp, Artificial Sequence
  Description of Artificial Sequence: Synthetic oligonucleotide
accaggctgggctttggact

SEQ ID NO: 4477 - DNA, 20 bp, Artificial Sequence
  Description of Artificial Sequence: Synthetic oligonucleotide
ccaggctgggctttggactt

SEQ ID NO: 4478 - DNA, 20 bp, Artificial Sequence
  Description of Artificial Sequence: Synthetic oligonucleotide
caggctgggctttggacttg

SEQ ID NO: 4479 - DNA, 20 bp, Artificial Sequence
  Description of Artificial Sequence: Synthetic oligonucleotide
aggctgggctttggacttga

SEQ ID NO: 4480 - DNA, 20 bp, Artificial Sequence
  Description of Artificial Sequence: Synthetic oligonucleotide
ggctgggctttggacttgac

SEQ ID NO: 4481 - DNA, 20 bp, Artificial Sequence
  Description of Artificial Sequence: Synthetic oligonucleotide
gctgggctttggacttgact

SEQ ID NO: 4482 - DNA, 20 bp, Artificial Sequence
  Description of Artificial Sequence: Synthetic oligonucleotide
ctgggctttggacttgactt

SEQ ID NO: 4483 - DNA, 20 bp, Artificial Sequence
  Description of Artificial Sequence: Synthetic oligonucleotide
tgggctttggacttgacttt

SEQ ID NO: 4484 - DNA, 20 bp, Artificial Sequence
  Description of Artificial Sequence: Synthetic oligonucleotide
gggctttggacttgactttt

SEQ ID NO: 4485 - DNA, 20 bp, Artificial Sequence
  Description of Artificial Sequence: Synthetic oligonucleotide
ggctttggacttgacttttt

SEQ ID NO: 4486 - DNA, 20 bp, Artificial Sequence
  Description of Artificial Sequence: Synthetic oligonucleotide
gctttggacttgactttttt

SEQ ID NO: 4487 - DNA, 20 bp, Artificial Sequence
  Description of Artificial Sequence: Synthetic oligonucleotide
ctttggacttgacttttttt

SEQ ID NO: 4488 - DNA, 20 bp, Artificial Sequence
  Description of Artificial Sequence: Synthetic oligonucleotide
tttggacttgactttttttt

SEQ ID NO: 4489 - DNA, 20 bp, Artificial Sequence
  Description of Artificial Sequence: Synthetic oligonucleotide
ttggacttgacttttttttt

SEQ ID NO: 4490 - DNA, 20 bp, Artificial Sequence
  Description of Artificial Sequence: Synthetic oligonucleotide
tggacttgactttttttttt

SEQ ID NO: 4491 - DNA, 20 bp, Artificial Sequence
  Description of Artificial Sequence: Synthetic oligonucleotide
ggacttgacttttttttttt

SEQ ID NO: 4492 - DNA, 20 bp, Artificial Sequence
  Description of Artificial Sequence: Synthetic oligonucleotide
gacttgactttttttttttt

SEQ ID NO: 4493 - DNA, 20 bp, Artificial Sequence
  Description of Artificial Sequence: Synthetic oligonucleotide
acttgacttttttttttttg

SEQ ID NO: 4494 - DNA, 20 bp, Artificial Sequence
  Description of Artificial Sequence: Synthetic oligonucleotide
cttgacttttttttttttga

SEQ ID NO: 4495 - DNA, 20 bp, Artificial Sequence
  Description of Artificial Sequence: Synthetic oligonucleotide
ttgacttttttttttttgag

SEQ ID NO: 4496 - DNA, 20 bp, Artificial Sequence
  Description of Artificial Sequence: Synthetic oligonucleotide
tgacttttttttttttgaga

SEQ ID NO: 4497 - DNA, 20 bp, Artificial Sequence
  Description of Artificial Sequence: Synthetic oligonucleotide
gacttttttttttttgagat

SEQ ID NO: 4498 - DNA, 20 bp, Artificial Sequence
  Description of Artificial Sequence: Synthetic oligonucleotide
acttttttttttttgagatt

SEQ ID NO: 4499 - DNA, 20 bp, Artificial Sequence
  Description of Artificial Sequence: Synthetic oligonucleotide
cttttttttttttgagattg

SEQ ID NO: 4500 - DNA, 20 bp, Artificial Sequence
  Description of Artificial Sequence: Synthetic oligonucleotide
ttttttttttttgagattga

SEQ ID NO: 4501 - DNA, 20 bp, Artificial Sequence
  Description of Artificial Sequence: Synthetic oligonucleotide
tttttttttttgagattgag

SEQ ID NO: 4502 - DNA, 20 bp, Artificial Sequence
  Description of Artificial Sequence: Synthetic oligonucleotide
ttttttttttgagattgagt

SEQ ID NO: 4503 - DNA, 20 bp, Artificial Sequence
  Description of Artificial Sequence: Synthetic oligonucleotide
tttttttttgagattgagtc

SEQ ID NO: 4504 - DNA, 20 bp, Artificial Sequence
  Description of Artificial Sequence: Synthetic oligonucleotide
ttttttttgagattgagtct

SEQ ID NO: 4505 - DNA, 20 bp, Artificial Sequence
  Description of Artificial Sequence: Synthetic oligonucleotide
tttttttgagattgagtctt

SEQ ID NO: 4506 - DNA, 20 bp, Artificial Sequence
  Description of Artificial Sequence: Synthetic oligonucleotide
ttttttgagattgagtctta

SEQ ID NO: 4507 - DNA, 20 bp, Artificial Sequence
  Description of Artificial Sequence: Synthetic oligonucleotide
tttttgagattgagtcttac

SEQ ID NO: 4508 - DNA, 20 bp, Artificial Sequence
  Description of Artificial Sequence: Synthetic oligonucleotide
ttttgagattgagtcttact

SEQ ID NO: 4509 - DNA, 20 bp, Artificial Sequence
  Description of Artificial Sequence: Synthetic oligonucleotide
tttgagattgagtcttactc

SEQ ID NO: 4510 - DNA, 20 bp, Artificial Sequence
  Description of Artificial Sequence: Synthetic oligonucleotide
ttgagattgagtcttactct

SEQ ID NO: 4511 - DNA, 20 bp, Artificial Sequence
  Description of Artificial Sequence: Synthetic oligonucleotide
tgagattgagtcttactctg

SEQ ID NO: 4512 - DNA, 20 bp, Artificial Sequence
  Description of Artificial Sequence: Synthetic oligonucleotide
gagattgagtcttactctgt

SEQ ID NO: 4513 - DNA, 20 bp, Artificial Sequence
  Description of Artificial Sequence: Synthetic oligonucleotide
agattgagtcttactctgtc

SEQ ID NO: 4514 - DNA, 20 bp, Artificial Sequence
  Description of Artificial Sequence: Synthetic oligonucleotide
gattgagtcttactctgtca

SEQ ID NO: 4515 - DNA, 20 bp, Artificial Sequence
  Description of Artificial Sequence: Synthetic oligonucleotide
attgagtcttactctgtcac

SEQ ID NO: 4516 - DNA, 20 bp, Artificial Sequence
  Description of Artificial Sequence: Synthetic oligonucleotide
ttgagtcttactctgtcacc

SEQ ID NO: 4517 - DNA, 20 bp, Artificial Sequence
  Description of Artificial Sequence: Synthetic oligonucleotide
tgagtcttactctgtcaccc

SEQ ID NO: 4518 - DNA, 20 bp, Artificial Sequence
  Description of Artificial Sequence: Synthetic oligonucleotide
gagtcttactctgtcaccca

SEQ ID NO: 4519 - DNA, 20 bp, Artificial Sequence
  Description of Artificial Sequence: Synthetic oligonucleotide
agtcttactctgtcacccag

SEQ ID NO: 4520 - DNA, 20 bp, Artificial Sequence
  Description of Artificial Sequence: Synthetic oligonucleotide
gtcttactctgtcacccagg

SEQ ID NO: 4521 - DNA, 20 bp, Artificial Sequence
  Description of Artificial Sequence: Synthetic oligonucleotide
tcttactctgtcacccaggc

SEQ ID NO: 4522 - DNA, 20 bp, Artificial Sequence
  Description of Artificial Sequence: Synthetic oligonucleotide
cttactctgtcacccaggct

SEQ ID NO: 4523 - DNA, 20 bp, Artificial Sequence
  Description of Artificial Sequence: Synthetic oligonucleotide
ttactctgtcacccaggctg

SEQ ID NO: 4524 - DNA, 20 bp, Artificial Sequence
  Description of Artificial Sequence: Synthetic oligonucleotide
tactctgtcacccaggctgg

SEQ ID NO: 4525 - DNA, 20 bp, Artificial Sequence
  Description of Artificial Sequence: Synthetic oligonucleotide
actctgtcacccaggctgga

SEQ ID NO: 4526 - DNA, 20 bp, Artificial Sequence
  Description of Artificial Sequence: Synthetic oligonucleotide
ctctgtcacccaggctggag

SEQ ID NO: 4527 - DNA, 20 bp, Artificial Sequence
  Description of Artificial Sequence: Synthetic oligonucleotide
tctgtcacccaggctggagt

SEQ ID NO: 4528 - DNA, 20 bp, Artificial Sequence
  Description of Artificial Sequence: Synthetic oligonucleotide
ctgtcacccaggctggagtg

SEQ ID NO: 4529 - DNA, 20 bp, Artificial Sequence
  Description of Artificial Sequence: Synthetic oligonucleotide
tgtcacccaggctggagtgc

SEQ ID NO: 4530 - DNA, 20 bp, Artificial Sequence
  Description of Artificial Sequence: Synthetic oligonucleotide
gtcacccaggctggagtgca

SEQ ID NO: 4531 - DNA, 20 bp, Artificial Sequence
  Description of Artificial Sequence: Synthetic oligonucleotide
tcacccaggctggagtgcag

SEQ ID NO: 4532 - DNA, 20 bp, Artificial Sequence
  Description of Artificial Sequence: Synthetic oligonucleotide
cacccaggctggagtgcagt

SEQ ID NO: 4533 - DNA, 20 bp, Artificial Sequence
  Description of Artificial Sequence: Synthetic oligonucleotide
acccaggctggagtgcagtg

SEQ ID NO: 4534 - DNA, 20 bp, Artificial Sequence
  Description of Artificial Sequence: Synthetic oligonucleotide
cccaggctggagtgcagtgg

SEQ ID NO: 4535 - DNA, 20 bp, Artificial Sequence
  Description of Artificial Sequence: Synthetic oligonucleotide
ccaggctggagtgcagtggt

SEQ ID NO: 4536 - DNA, 20 bp, Artificial Sequence
  Description of Artificial Sequence: Synthetic oligonucleotide
caggctggagtgcagtggtg

SEQ ID NO: 4537 - DNA, 20 bp, Artificial Sequence
  Description of Artificial Sequence: Synthetic oligonucleotide
aggctggagtgcagtggtgc

SEQ ID NO: 4538 - DNA, 20 bp, Artificial Sequence
  Description of Artificial Sequence: Synthetic oligonucleotide
ggctggagtgcagtggtgcg

SEQ ID NO: 4539 - DNA, 20 bp, Artificial Sequence
  Description of Artificial Sequence: Synthetic oligonucleotide
gctggagtgcagtggtgcga

SEQ ID NO: 4540 - DNA, 20 bp, Artificial Sequence
  Description of Artificial Sequence: Synthetic oligonucleotide
ctggagtgcagtggtgcgat

SEQ ID NO: 4541 - DNA, 20 bp, Artificial Sequence
  Description of Artificial Sequence: Synthetic oligonucleotide
tggagtgcagtggtgcgatc

SEQ ID NO: 4542 - DNA, 20 bp, Artificial Sequence
  Description of Artificial Sequence: Synthetic oligonucleotide
ggagtgcagtggtgcgatct

SEQ ID NO: 4543 - DNA, 20 bp, Artificial Sequence
  Description of Artificial Sequence: Synthetic oligonucleotide
gagtgcagtggtgcgatctc

SEQ ID NO: 4544 - DNA, 20 bp, Artificial Sequence
  Description of Artificial Sequence: Synthetic oligonucleotide
agtgcagtggtgcgatctca

SEQ ID NO: 4545 - DNA, 20 bp, Artificial Sequence
  Description of Artificial Sequence: Synthetic oligonucleotide
gtgcagtggtgcgatctcag

SEQ ID NO: 4546 - DNA, 20 bp, Artificial Sequence
  Description of Artificial Sequence: Synthetic oligonucleotide
tgcagtggtgcgatctcagc

SEQ ID NO: 4547 - DNA, 20 bp, Artificial Sequence
  Description of Artificial Sequence: Synthetic oligonucleotide
gcagtggtgcgatctcagct

SEQ ID NO: 4548 - DNA, 20 bp, Artificial Sequence
  Description of Artificial Sequence: Synthetic oligonucleotide
cagtggtgcgatctcagctc

SEQ ID NO: 4549 - DNA, 20 bp, Artificial Sequence
  Description of Artificial Sequence: Synthetic oligonucleotide
agtggtgcgatctcagctca

SEQ ID NO: 4550 - DNA, 20 bp, Artificial Sequence
  Description of Artificial Sequence: Synthetic oligonucleotide
gtggtgcgatctcagctcac

SEQ ID NO: 4551 - DNA, 20 bp, Artificial Sequence
  Description of Artificial Sequence: Synthetic oligonucleotide
tggtgcgatctcagctcact

SEQ ID NO: 4552 - DNA, 20 bp, Artificial Sequence
  Description of Artificial Sequence: Synthetic oligonucleotide
ggtgcgatctcagctcactg

SEQ ID NO: 4553 - DNA, 20 bp, Artificial Sequence
  Description of Artificial Sequence: Synthetic oligonucleotide
gtgcgatctcagctcactgc

SEQ ID NO: 4554 - DNA, 20 bp, Artificial Sequence
  Description of Artificial Sequence: Synthetic oligonucleotide
tgcgatctcagctcactgca

SEQ ID NO: 4555 - DNA, 20 bp, Artificial Sequence
  Description of Artificial Sequence: Synthetic oligonucleotide
gcgatctcagctcactgcaa

SEQ ID NO: 4556 - DNA, 20 bp, Artificial Sequence
  Description of Artificial Sequence: Synthetic oligonucleotide
cgatctcagctcactgcaac

SEQ ID NO: 4557 - DNA, 20 bp, Artificial Sequence
  Description of Artificial Sequence: Synthetic oligonucleotide
gatctcagctcactgcaacc

SEQ ID NO: 4558 - DNA, 20 bp, Artificial Sequence
  Description of Artificial Sequence: Synthetic oligonucleotide
atctcagctcactgcaacct

SEQ ID NO: 4559 - DNA, 20 bp, Artificial Sequence
  Description of Artificial Sequence: Synthetic oligonucleotide
tctcagctcactgcaacctc

SEQ ID NO: 4560 - DNA, 20 bp, Artificial Sequence
  Description of Artificial Sequence: Synthetic oligonucleotide
ctcagctcactgcaacctcc

SEQ ID NO: 4561 - DNA, 20 bp, Artificial Sequence
  Description of Artificial Sequence: Synthetic oligonucleotide
tcagctcactgcaacctccg

SEQ ID NO: 4562 - DNA, 20 bp, Artificial Sequence
  Description of Artificial Sequence: Synthetic oligonucleotide
cagctcactgcaacctccgt

SEQ ID NO: 4563 - DNA, 20 bp, Artificial Sequence
  Description of Artificial Sequence: Synthetic oligonucleotide
agctcactgcaacctccgtc

SEQ ID NO: 4564 - DNA, 20 bp, Artificial Sequence
  Description of Artificial Sequence: Synthetic oligonucleotide
gctcactgcaacctccgtct

SEQ ID NO: 4565 - DNA, 20 bp, Artificial Sequence
  Description of Artificial Sequence: Synthetic oligonucleotide
ctcactgcaacctccgtctc

SEQ ID NO: 4566 - DNA, 20 bp, Artificial Sequence
  Description of Artificial Sequence: Synthetic oligonucleotide
tcactgcaacctccgtctct

SEQ ID NO: 4567 - DNA, 20 bp, Artificial Sequence
  Description of Artificial Sequence: Synthetic oligonucleotide
cactgcaacctccgtctctc

SEQ ID NO: 4568 - DNA, 20 bp, Artificial Sequence
  Description of Artificial Sequence: Synthetic oligonucleotide
actgcaacctccgtctctca

SEQ ID NO: 4569 - DNA, 20 bp, Artificial Sequence
  Description of Artificial Sequence: Synthetic oligonucleotide
ctgcaacctccgtctctcag

SEQ ID NO: 4570 - DNA, 20 bp, Artificial Sequence
  Description of Artificial Sequence: Synthetic oligonucleotide
tgcaacctccgtctctcagg

SEQ ID NO: 4571 - DNA, 20 bp, Artificial Sequence
  Description of Artificial Sequence: Synthetic oligonucleotide
gcaacctccgtctctcaggt

SEQ ID NO: 4572 - DNA, 20 bp, Artificial Sequence
  Description of Artificial Sequence: Synthetic oligonucleotide
caacctccgtctctcaggtt

SEQ ID NO: 4573 - DNA, 20 bp, Artificial Sequence
  Description of Artificial Sequence: Synthetic oligonucleotide
aacctccgtctctcaggttt

SEQ ID NO: 4574 - DNA, 20 bp, Artificial Sequence
  Description of Artificial Sequence: Synthetic oligonucleotide
acctccgtctctcaggttta

SEQ ID NO: 4575 - DNA, 20 bp, Artificial Sequence
  Description of Artificial Sequence: Synthetic oligonucleotide
cctccgtctctcaggtttaa

SEQ ID NO: 4576 - DNA, 20 bp, Artificial Sequence
  Description of Artificial Sequence: Synthetic oligonucleotide
ctccgtctctcaggtttaag

SEQ ID NO: 4577 - DNA, 20 bp, Artificial Sequence
  Description of Artificial Sequence: Synthetic oligonucleotide
tccgtctctcaggtttaagt

SEQ ID NO: 4578 - DNA, 20 bp, Artificial Sequence
  Description of Artificial Sequence: Synthetic oligonucleotide
ccgtctctcaggtttaagtg

SEQ ID NO: 4579 - DNA, 20 bp, Artificial Sequence
  Description of Artificial Sequence: Synthetic oligonucleotide
cgtctctcaggtttaagtga

SEQ ID NO: 4580 - DNA, 20 bp, Artificial Sequence
  Description of Artificial Sequence: Synthetic oligonucleotide
gtctctcaggtttaagtgat

SEQ ID NO: 4581 - DNA, 20 bp, Artificial Sequence
  Description of Artificial Sequence: Synthetic oligonucleotide
tctctcaggtttaagtgatt

SEQ ID NO: 4582 - DNA, 20 bp, Artificial Sequence
  Description of Artificial Sequence: Synthetic oligonucleotide
ctctcaggtttaagtgattc

SEQ ID NO: 4583 - DNA, 20 bp, Artificial Sequence
  Description of Artificial Sequence: Synthetic oligonucleotide
tctcaggtttaagtgattct

SEQ ID NO: 4584 - DNA, 20 bp, Artificial Sequence
  Description of Artificial Sequence: Synthetic oligonucleotide
ctcaggtttaagtgattctc

SEQ ID NO: 4585 - DNA, 20 bp, Artificial Sequence
  Description of Artificial Sequence: Synthetic oligonucleotide
tcaggtttaagtgattctcc

SEQ ID NO: 4586 - DNA, 20 bp, Artificial Sequence
  Description of Artificial Sequence: Synthetic oligonucleotide
caggtttaagtgattctcct

SEQ ID NO: 4587 - DNA, 20 bp, Artificial Sequence
  Description of Artificial Sequence: Synthetic oligonucleotide
aggtttaagtgattctcctc

SEQ ID NO: 4588 - DNA, 20 bp, Artificial Sequence
  Description of Artificial Sequence: Synthetic oligonucleotide
ggtttaagtgattctcctcc

SEQ ID NO: 4589 - DNA, 20 bp, Artificial Sequence
  Description of Artificial Sequence: Synthetic oligonucleotide
gtttaagtgattctcctccc

SEQ ID NO: 4590 - DNA, 20 bp, Artificial Sequence
  Description of Artificial Sequence: Synthetic oligonucleotide
tttaagtgattctcctccct

SEQ ID NO: 4591 - DNA, 20 bp, Artificial Sequence
  Description of Artificial Sequence: Synthetic oligonucleotide
ttaagtgattctcctccctc

SEQ ID NO: 4592 - DNA, 20 bp, Artificial Sequence
  Description of Artificial Sequence: Synthetic oligonucleotide
taagtgattctcctccctca

SEQ ID NO: 4593 - DNA, 20 bp, Artificial Sequence
  Description of Artificial Sequence: Synthetic oligonucleotide
aagtgattctcctccctcag

SEQ ID NO: 4594 - DNA, 20 bp, Artificial Sequence
  Description of Artificial Sequence: Synthetic oligonucleotide
agtgattctcctccctcagc

SEQ ID NO: 4595 - DNA, 20 bp, Artificial Sequence
  Description of Artificial Sequence: Synthetic oligonucleotide
gtgattctcctccctcagcc

SEQ ID NO: 4596 - DNA, 20 bp, Artificial Sequence
  Description of Artificial Sequence: Synthetic oligonucleotide
tgattctcctccctcagcct

SEQ ID NO: 4597 - DNA, 20 bp, Artificial Sequence
  Description of Artificial Sequence: Synthetic oligonucleotide
gattctcctccctcagcctc

SEQ ID NO: 4598 - DNA, 20 bp, Artificial Sequence
  Description of Artificial Sequence: Synthetic oligonucleotide
attctcctccctcagcctcc

SEQ ID NO: 4599 - DNA, 20 bp, Artificial Sequence
  Description of Artificial Sequence: Synthetic oligonucleotide
ttctcctccctcagcctccc

SEQ ID NO: 4600 - DNA, 20 bp, Artificial Sequence
  Description of Artificial Sequence: Synthetic oligonucleotide
tctcctccctcagcctcccg

SEQ ID NO: 4601 - DNA, 20 bp, Artificial Sequence
  Description of Artificial Sequence: Synthetic oligonucleotide
ctcctccctcagcctcccga

SEQ ID NO: 4602 - DNA, 20 bp, Artificial Sequence
  Description of Artificial Sequence: Synthetic oligonucleotide
tcctccctcagcctcccgag

SEQ ID NO: 4603 - DNA, 20 bp, Artificial Sequence
  Description of Artificial Sequence: Synthetic oligonucleotide
cctccctcagcctcccgagt

SEQ ID NO: 4604 - DNA, 20 bp, Artificial Sequence
  Description of Artificial Sequence: Synthetic oligonucleotide
ctccctcagcctcccgagta

SEQ ID NO: 4605 - DNA, 20 bp, Artificial Sequence
  Description of Artificial Sequence: Synthetic oligonucleotide
tccctcagcctcccgagtag

SEQ ID NO: 4606 - DNA, 20 bp, Artificial Sequence
  Description of Artificial Sequence: Synthetic oligonucleotide
ccctcagcctcccgagtagc

SEQ ID NO: 4607 - DNA, 20 bp, Artificial Sequence
  Description of Artificial Sequence: Synthetic oligonucleotide
cctcagcctcccgagtagct

SEQ ID NO: 4608 - DNA, 20 bp, Artificial Sequence
  Description of Artificial Sequence: Synthetic oligonucleotide
ctcagcctcccgagtagctg

SEQ ID NO: 4609 - DNA, 20 bp, Artificial Sequence
  Description of Artificial Sequence: Synthetic oligonucleotide
tcagcctcccgagtagctgg

SEQ ID NO: 4610 - DNA, 20 bp, Artificial Sequence
  Description of Artificial Sequence: Synthetic oligonucleotide
cagcctcccgagtagctggg

SEQ ID NO: 4611 - DNA, 20 bp, Artificial Sequence
  Description of Artificial Sequence: Synthetic oligonucleotide
agcctcccgagtagctggga

SEQ ID NO: 4612 - DNA, 20 bp, Artificial Sequence
  Description of Artificial Sequence: Synthetic oligonucleotide
gcctcccgagtagctgggat

SEQ ID NO: 4613 - DNA, 20 bp, Artificial Sequence
  Description of Artificial Sequence: Synthetic oligonucleotide
cctcccgagtagctgggatt

SEQ ID NO: 4614 - DNA, 20 bp, Artificial Sequence
  Description of Artificial Sequence: Synthetic oligonucleotide
ctcccgagtagctgggatta

SEQ ID NO: 4615 - DNA, 20 bp, Artificial Sequence
  Description of Artificial Sequence: Synthetic oligonucleotide
tcccgagtagctgggattac

SEQ ID NO: 4616 - DNA, 20 bp, Artificial Sequence
  Description of Artificial Sequence: Synthetic oligonucleotide
cccgagtagctgggattaca

SEQ ID NO: 4617 - DNA, 20 bp, Artificial Sequence
  Description of Artificial Sequence: Synthetic oligonucleotide
ccgagtagctgggattacag

SEQ ID NO: 4618 - DNA, 20 bp, Artificial Sequence
  Description of Artificial Sequence: Synthetic oligonucleotide
cgagtagctgggattacagg

SEQ ID NO: 4619 - DNA, 20 bp, Artificial Sequence
  Description of Artificial Sequence: Synthetic oligonucleotide
gagtagctgggattacaggc

SEQ ID NO: 4620 - DNA, 20 bp, Artificial Sequence
  Description of Artificial Sequence: Synthetic oligonucleotide
agtagctgggattacaggcg

SEQ ID NO: 4621 - DNA, 20 bp, Artificial Sequence
  Description of Artificial Sequence: Synthetic oligonucleotide
gtagctgggattacaggcgc

SEQ ID NO: 4622 - DNA, 20 bp, Artificial Sequence
  Description of Artificial Sequence: Synthetic oligonucleotide
tagctgggattacaggcgcc

SEQ ID NO: 4623 - DNA, 20 bp, Artificial Sequence
  Description of Artificial Sequence: Synthetic oligonucleotide
agctgggattacaggcgcct

SEQ ID NO: 4624 - DNA, 20 bp, Artificial Sequence
  Description of Artificial Sequence: Synthetic oligonucleotide
gctgggattacaggcgcctg

SEQ ID NO: 4625 - DNA, 20 bp, Artificial Sequence
  Description of Artificial Sequence: Synthetic oligonucleotide
ctgggattacaggcgcctgc

SEQ ID NO: 4626 - DNA, 20 bp, Artificial Sequence
  Description of Artificial Sequence: Synthetic oligonucleotide
tgggattacaggcgcctgcc

SEQ ID NO: 4627 - DNA, 20 bp, Artificial Sequence
  Description of Artificial Sequence: Synthetic oligonucleotide
gggattacaggcgcctgcca

SEQ ID NO: 4628 - DNA, 20 bp, Artificial Sequence
  Description of Artificial Sequence: Synthetic oligonucleotide
ggattacaggcgcctgccac

SEQ ID NO: 4629 - DNA, 20 bp, Artificial Sequence
  Description of Artificial Sequence: Synthetic oligonucleotide
gattacaggcgcctgccacc

SEQ ID NO: 4630 - DNA, 20 bp, Artificial Sequence
  Description of Artificial Sequence: Synthetic oligonucleotide
attacaggcgcctgccacca

SEQ ID NO: 4631 - DNA, 20 bp, Artificial Sequence
  Description of Artificial Sequence: Synthetic oligonucleotide
ttacaggcgcctgccaccac

SEQ ID NO: 4632 - DNA, 20 bp, Artificial Sequence
  Description of Artificial Sequence: Synthetic oligonucleotide
tacaggcgcctgccaccaca

SEQ ID NO: 4633 - DNA, 20 bp, Artificial Sequence
  Description of Artificial Sequence: Synthetic oligonucleotide
acaggcgcctgccaccacac

SEQ ID NO: 4634 - DNA, 20 bp, Artificial Sequence
  Description of Artificial Sequence: Synthetic oligonucleotide
caggcgcctgccaccacacc

SEQ ID NO: 4635 - DNA, 20 bp, Artificial Sequence
  Description of Artificial Sequence: Synthetic oligonucleotide
aggcgcctgccaccacacct

SEQ ID NO: 4636 - DNA, 20 bp, Artificial Sequence
  Description of Artificial Sequence: Synthetic oligonucleotide
ggcgcctgccaccacacctg

SEQ ID NO: 4637 - DNA, 20 bp, Artificial Sequence
  Description of Artificial Sequence: Synthetic oligonucleotide
gcgcctgccaccacacctgg

SEQ ID NO: 4638 - DNA, 20 bp, Artificial Sequence
  Description of Artificial Sequence: Synthetic oligonucleotide
cgcctgccaccacacctggc

SEQ ID NO: 4639 - DNA, 20 bp, Artificial Sequence
  Description of Artificial Sequence: Synthetic oligonucleotide
gcctgccaccacacctggct

SEQ ID NO: 4640 - DNA, 20 bp, Artificial Sequence
  Description of Artificial Sequence: Synthetic oligonucleotide
cctgccaccacacctggcta

SEQ ID NO: 4641 - DNA, 20 bp, Artificial Sequence
  Description of Artificial Sequence: Synthetic oligonucleotide
ctgccaccacacctggctaa

SEQ ID NO: 4642 - DNA, 20 bp, Artificial Sequence
  Description of Artificial Sequence: Synthetic oligonucleotide
tgccaccacacctggctaat

SEQ ID NO: 4643 - DNA, 20 bp, Artificial Sequence
  Description of Artificial Sequence: Synthetic oligonucleotide
gccaccacacctggctaatt

SEQ ID NO: 4644 - DNA, 20 bp, Artificial Sequence
  Description of Artificial Sequence: Synthetic oligonucleotide
ccaccacacctggctaattt

SEQ ID NO: 4645 - DNA, 20 bp, Artificial Sequence
  Description of Artificial Sequence: Synthetic oligonucleotide
caccacacctggctaatttt

SEQ ID NO: 4646 - DNA, 20 bp, Artificial Sequence
  Description of Artificial Sequence: Synthetic oligonucleotide
accacacctggctaattttt

SEQ ID NO: 4647 - DNA, 20 bp, Artificial Sequence
  Description of Artificial Sequence: Synthetic oligonucleotide
ccacacctggctaatttttg

SEQ ID NO: 4648 - DNA, 20 bp, Artificial Sequence
  Description of Artificial Sequence: Synthetic oligonucleotide
cacacctggctaatttttgg

SEQ ID NO: 4649 - DNA, 20 bp, Artificial Sequence
  Description of Artificial Sequence: Synthetic oligonucleotide
acacctggctaatttttggt

SEQ ID NO: 4650 - DNA, 20 bp, Artificial Sequence
  Description of Artificial Sequence: Synthetic oligonucleotide
cacctggctaatttttggtc

SEQ ID NO: 4651 - DNA, 20 bp, Artificial Sequence
  Description of Artificial Sequence: Synthetic oligonucleotide
acctggctaatttttggtct

SEQ ID NO: 4652 - DNA, 20 bp, Artificial Sequence
  Description of Artificial Sequence: Synthetic oligonucleotide
cctggctaatttttggtctt

SEQ ID NO: 4653 - DNA, 20 bp, Artificial Sequence
  Description of Artificial Sequence: Synthetic oligonucleotide
ctggctaatttttggtcttt

SEQ ID NO: 4654 - DNA, 20 bp, Artificial Sequence
  Description of Artificial Sequence: Synthetic oligonucleotide
tggctaatttttggtctttt

SEQ ID NO: 4655 - DNA, 20 bp, Artificial Sequence
  Description of Artificial Sequence: Synthetic oligonucleotide
ggctaatttttggtcttttt

SEQ ID NO: 4656 - DNA, 20 bp, Artificial Sequence
  Description of Artificial Sequence: Synthetic oligonucleotide
gctaatttttggtctttttt

SEQ ID NO: 4657 - DNA, 20 bp, Artificial Sequence
  Description of Artificial Sequence: Synthetic oligonucleotide
ctaatttttggtcttttttt

SEQ ID NO: 4658 - DNA, 20 bp, Artificial Sequence
  Description of Artificial Sequence: Synthetic oligonucleotide
taatttttggtctttttttt

SEQ ID NO: 4659 - DNA, 20 bp, Artificial Sequence
  Description of Artificial Sequence: Synthetic oligonucleotide
aatttttggtcttttttttt

SEQ ID NO: 4660 - DNA, 20 bp, Artificial Sequence
  Description of Artificial Sequence: Synthetic oligonucleotide
atttttggtctttttttttg

SEQ ID NO: 4661 - DNA, 20 bp, Artificial Sequence
  Description of Artificial Sequence: Synthetic oligonucleotide
tttttggtctttttttttga

SEQ ID NO: 4662 - DNA, 20 bp, Artificial Sequence
  Description of Artificial Sequence: Synthetic oligonucleotide
ttttggtctttttttttgag

SEQ ID NO: 4663 - DNA, 20 bp, Artificial Sequence
  Description of Artificial Sequence: Synthetic oligonucleotide
tttggtctttttttttgaga

SEQ ID NO: 4664 - DNA, 20 bp, Artificial Sequence
  Description of Artificial Sequence: Synthetic oligonucleotide
ttggtctttttttttgagac

SEQ ID NO: 4665 - DNA, 20 bp, Artificial Sequence
  Description of Artificial Sequence: Synthetic oligonucleotide
tggtctttttttttgagact

SEQ ID NO: 4666 - DNA, 20 bp, Artificial Sequence
  Description of Artificial Sequence: Synthetic oligonucleotide
ggtctttttttttgagactg

SEQ ID NO: 4667 - DNA, 20 bp, Artificial Sequence
  Description of Artificial Sequence: Synthetic oligonucleotide
gtctttttttttgagactga

SEQ ID NO: 4668 - DNA, 20 bp, Artificial Sequence
  Description of Artificial Sequence: Synthetic oligonucleotide
tctttttttttgagactgag

SEQ ID NO: 4669 - DNA, 20 bp, Artificial Sequence
  Description of Artificial Sequence: Synthetic oligonucleotide
ctttttttttgagactgagt

SEQ ID NO: 4670 - DNA, 20 bp, Artificial Sequence
  Description of Artificial Sequence: Synthetic oligonucleotide
tttttttttgagactgagtc

SEQ ID NO: 4671 - DNA, 20 bp, Artificial Sequence
  Description of Artificial Sequence: Synthetic oligonucleotide
ttttttttgagactgagtct

SEQ ID NO: 4672 - DNA, 20 bp, Artificial Sequence
  Description of Artificial Sequence: Synthetic oligonucleotide
tttttttgagactgagtctc

SEQ ID NO: 4673 - DNA, 20 bp, Artificial Sequence
  Description of Artificial Sequence: Synthetic oligonucleotide
ttttttgagactgagtctca

SEQ ID NO: 4674 - DNA, 20 bp, Artificial Sequence
  Description of Artificial Sequence: Synthetic oligonucleotide
tttttgagactgagtctcac

SEQ ID NO: 4675 - DNA, 20 bp, Artificial Sequence
  Description of Artificial Sequence: Synthetic oligonucleotide
ttttgagactgagtctcact

SEQ ID NO: 4676 - DNA, 20 bp, Artificial Sequence
  Description of Artificial Sequence: Synthetic oligonucleotide
tttgagactgagtctcactc

SEQ ID NO: 4677 - DNA, 20 bp, Artificial Sequence
  Description of Artificial Sequence: Synthetic oligonucleotide
ttgagactgagtctcactct

SEQ ID NO: 4678 - DNA, 20 bp, Artificial Sequence
  Description of Artificial Sequence: Synthetic oligonucleotide
tgagactgagtctcactcta

SEQ ID NO: 4679 - DNA, 20 bp, Artificial Sequence
  Description of Artificial Sequence: Synthetic oligonucleotide
gagactgagtctcactctat

SEQ ID NO: 4680 - DNA, 20 bp, Artificial Sequence
  Description of Artificial Sequence: Synthetic oligonucleotide
agactgagtctcactctatc

SEQ ID NO: 4681 - DNA, 20 bp, Artificial Sequence
  Description of Artificial Sequence: Synthetic oligonucleotide
gactgagtctcactctatct

SEQ ID NO: 4682 - DNA, 20 bp, Artificial Sequence
  Description of Artificial Sequence: Synthetic oligonucleotide
actgagtctcactctatctc

SEQ ID NO: 4683 - DNA, 20 bp, Artificial Sequence
  Description of Artificial Sequence: Synthetic oligonucleotide
ctgagtctcactctatctcc

SEQ ID NO: 4684 - DNA, 20 bp, Artificial Sequence
  Description of Artificial Sequence: Synthetic oligonucleotide
tgagtctcactctatctccc

SEQ ID NO: 4685 - DNA, 20 bp, Artificial Sequence
  Description of Artificial Sequence: Synthetic oligonucleotide
gagtctcactctatctccca

SEQ ID NO: 4686 - DNA, 20 bp, Artificial Sequence
  Description of Artificial Sequence: Synthetic oligonucleotide
agtctcactctatctcccag

SEQ ID NO: 4687 - DNA, 20 bp, Artificial Sequence
  Description of Artificial Sequence: Synthetic oligonucleotide
gtctcactctatctcccagg

SEQ ID NO: 4688 - DNA, 20 bp, Artificial Sequence
  Description of Artificial Sequence: Synthetic oligonucleotide
tctcactctatctcccaggc

SEQ ID NO: 4689 - DNA, 20 bp, Artificial Sequence
  Description of Artificial Sequence: Synthetic oligonucleotide
ctcactctatctcccaggct

SEQ ID NO: 4690 - DNA, 20 bp, Artificial Sequence
  Description of Artificial Sequence: Synthetic oligonucleotide
tcactctatctcccaggctg

SEQ ID NO: 4691 - DNA, 20 bp, Artificial Sequence
  Description of Artificial Sequence: Synthetic oligonucleotide
cactctatctcccaggctgg

SEQ ID NO: 4692 - DNA, 20 bp, Artificial Sequence
  Description of Artificial Sequence: Synthetic oligonucleotide
actctatctcccaggctgga

SEQ ID NO: 4693 - DNA, 20 bp, Artificial Sequence
  Description of Artificial Sequence: Synthetic oligonucleotide
ctctatctcccaggctggag

SEQ ID NO: 4694 - DNA, 20 bp, Artificial Sequence
  Description of Artificial Sequence: Synthetic oligonucleotide
tctatctcccaggctggagt

SEQ ID NO: 4695 - DNA, 20 bp, Artificial Sequence
  Description of Artificial Sequence: Synthetic oligonucleotide
ctatctcccaggctggagtg

SEQ ID NO: 4696 - DNA, 20 bp, Artificial Sequence
  Description of Artificial Sequence: Synthetic oligonucleotide
tatctcccaggctggagtgc

SEQ ID NO: 4697 - DNA, 20 bp, Artificial Sequence
  Description of Artificial Sequence: Synthetic oligonucleotide
atctcccaggctggagtgca

SEQ ID NO: 4698 - DNA, 20 bp, Artificial Sequence
  Description of Artificial Sequence: Synthetic oligonucleotide
tctcccaggctggagtgcag

SEQ ID NO: 4699 - DNA, 20 bp, Artificial Sequence
  Description of Artificial Sequence: Synthetic oligonucleotide
ctcccaggctggagtgcagt

SEQ ID NO: 4700 - DNA, 20 bp, Artificial Sequence
  Description of Artificial Sequence: Synthetic oligonucleotide
tcccaggctggagtgcagtg

SEQ ID NO: 4701 - DNA, 20 bp, Artificial Sequence
  Description of Artificial Sequence: Synthetic oligonucleotide
cccaggctggagtgcagtgg

SEQ ID NO: 4702 - DNA, 20 bp, Artificial Sequence
  Description of Artificial Sequence: Synthetic oligonucleotide
ccaggctggagtgcagtggc

SEQ ID NO: 4703 - DNA, 20 bp, Artificial Sequence
  Description of Artificial Sequence: Synthetic oligonucleotide
caggctggagtgcagtggca

SEQ ID NO: 4704 - DNA, 20 bp, Artificial Sequence
  Description of Artificial Sequence: Synthetic oligonucleotide
aggctggagtgcagtggcac

SEQ ID NO: 4705 - DNA, 20 bp, Artificial Sequence
  Description of Artificial Sequence: Synthetic oligonucleotide
ggctggagtgcagtggcaca

SEQ ID NO: 4706 - DNA, 20 bp, Artificial Sequence
  Description of Artificial Sequence: Synthetic oligonucleotide
gctggagtgcagtggcacaa

SEQ ID NO: 4707 - DNA, 20 bp, Artificial Sequence
  Description of Artificial Sequence: Synthetic oligonucleotide
ctggagtgcagtggcacaat

SEQ ID NO: 4708 - DNA, 20 bp, Artificial Sequence
  Description of Artificial Sequence: Synthetic oligonucleotide
tggagtgcagtggcacaatc

SEQ ID NO: 4709 - DNA, 20 bp, Artificial Sequence
  Description of Artificial Sequence: Synthetic oligonucleotide
ggagtgcagtggcacaatct

SEQ ID NO: 4710 - DNA, 20 bp, Artificial Sequence
  Description of Artificial Sequence: Synthetic oligonucleotide
gagtgcagtggcacaatctc

SEQ ID NO: 4711 - DNA, 20 bp, Artificial Sequence
  Description of Artificial Sequence: Synthetic oligonucleotide
agtgcagtggcacaatctcg

SEQ ID NO: 4712 - DNA, 20 bp, Artificial Sequence
  Description of Artificial Sequence: Synthetic oligonucleotide
gtgcagtggcacaatctcgg

SEQ ID NO: 4713 - DNA, 20 bp, Artificial Sequence
  Description of Artificial Sequence: Synthetic oligonucleotide
tgcagtggcacaatctcggc

SEQ ID NO: 4714 - DNA, 20 bp, Artificial Sequence
  Description of Artificial Sequence: Synthetic oligonucleotide
gcagtggcacaatctcggct

SEQ ID NO: 4715 - DNA, 20 bp, Artificial Sequence
  Description of Artificial Sequence: Synthetic oligonucleotide
cagtggcacaatctcggctc

SEQ ID NO: 4716 - DNA, 20 bp, Artificial Sequence
  Description of Artificial Sequence: Synthetic oligonucleotide
agtggcacaatctcggctca

SEQ ID NO: 4717 - DNA, 20 bp, Artificial Sequence
  Description of Artificial Sequence: Synthetic oligonucleotide
gtggcacaatctcggctcac

SEQ ID NO: 4718 - DNA, 20 bp, Artificial Sequence
  Description of Artificial Sequence: Synthetic oligonucleotide
tggcacaatctcggctcact

SEQ ID NO: 4719 - DNA, 20 bp, Artificial Sequence
  Description of Artificial Sequence: Synthetic oligonucleotide
ggcacaatctcggctcactg

SEQ ID NO: 4720 - DNA, 20 bp, Artificial Sequence
  Description of Artificial Sequence: Synthetic oligonucleotide
gcacaatctcggctcactgc

SEQ ID NO: 4721 - DNA, 20 bp, Artificial Sequence
  Description of Artificial Sequence: Synthetic oligonucleotide
cacaatctcggctcactgca

SEQ ID NO: 4722 - DNA, 20 bp, Artificial Sequence
  Description of Artificial Sequence: Synthetic oligonucleotide
acaatctcggctcactgcac

SEQ ID NO: 4723 - DNA, 20 bp, Artificial Sequence
  Description of Artificial Sequence: Synthetic oligonucleotide
caatctcggctcactgcacc

SEQ ID NO: 4724 - DNA, 20 bp, Artificial Sequence
  Description of Artificial Sequence: Synthetic oligonucleotide
aatctcggctcactgcacct

SEQ ID NO: 4725 - DNA, 20 bp, Artificial Sequence
  Description of Artificial Sequence: Synthetic oligonucleotide
atctcggctcactgcacctc

SEQ ID NO: 4726 - DNA, 20 bp, Artificial Sequence
  Description of Artificial Sequence: Synthetic oligonucleotide
tctcggctcactgcacctct

SEQ ID NO: 4727 - DNA, 20 bp, Artificial Sequence
  Description of Artificial Sequence: Synthetic oligonucleotide
ctcggctcactgcacctctg

SEQ ID NO: 4728 - DNA, 20 bp, Artificial Sequence
  Description of Artificial Sequence: Synthetic oligonucleotide
tcggctcactgcacctctgc

SEQ ID NO: 4729 - DNA, 20 bp, Artificial Sequence
  Description of Artificial Sequence: Synthetic oligonucleotide
cggctcactgcacctctgcc

SEQ ID NO: 4730 - DNA, 20 bp, Artificial Sequence
  Description of Artificial Sequence: Synthetic oligonucleotide
ggctcactgcacctctgcct

SEQ ID NO: 4731 - DNA, 20 bp, Artificial Sequence
  Description of Artificial Sequence: Synthetic oligonucleotide
gctcactgcacctctgcctc

SEQ ID NO: 4732 - DNA, 20 bp, Artificial Sequence
  Description of Artificial Sequence: Synthetic oligonucleotide
ctcactgcacctctgcctcc

SEQ ID NO: 4733 - DNA, 20 bp, Artificial Sequence
  Description of Artificial Sequence: Synthetic oligonucleotide
tcactgcacctctgcctccc

SEQ ID NO: 4734 - DNA, 20 bp, Artificial Sequence
  Description of Artificial Sequence: Synthetic oligonucleotide
cactgcacctctgcctccca

SEQ ID NO: 4735 - DNA, 20 bp, Artificial Sequence
  Description of Artificial Sequence: Synthetic oligonucleotide
actgcacctctgcctcccag

SEQ ID NO: 4736 - DNA, 20 bp, Artificial Sequence
  Description of Artificial Sequence: Synthetic oligonucleotide
ctgcacctctgcctcccagg

SEQ ID NO: 4737 - DNA, 20 bp, Artificial Sequence
  Description of Artificial Sequence: Synthetic oligonucleotide
tgcacctctgcctcccaggt

SEQ ID NO: 4738 - DNA, 20 bp, Artificial Sequence
  Description of Artificial Sequence: Synthetic oligonucleotide
gcacctctgcctcccaggtt

SEQ ID NO: 4739 - DNA, 20 bp, Artificial Sequence
  Description of Artificial Sequence: Synthetic oligonucleotide
cacctctgcctcccaggttc

SEQ ID NO: 4740 - DNA, 20 bp, Artificial Sequence
  Description of Artificial Sequence: Synthetic oligonucleotide
acctctgcctcccaggttca

SEQ ID NO: 4741 - DNA, 20 bp, Artificial Sequence
  Description of Artificial Sequence: Synthetic oligonucleotide
cctctgcctcccaggttcaa

SEQ ID NO: 4742 - DNA, 20 bp, Artificial Sequence
  Description of Artificial Sequence: Synthetic oligonucleotide
ctctgcctcccaggttcaag

SEQ ID NO: 4743 - DNA, 20 bp, Artificial Sequence
  Description of Artificial Sequence: Synthetic oligonucleotide
tctgcctcccaggttcaagg

SEQ ID NO: 4744 - DNA, 20 bp, Artificial Sequence
  Description of Artificial Sequence: Synthetic oligonucleotide
ctgcctcccaggttcaaggg

SEQ ID NO: 4745 - DNA, 20 bp, Artificial Sequence
  Description of Artificial Sequence: Synthetic oligonucleotide
tgcctcccaggttcaaggga

SEQ ID NO: 4746 - DNA, 20 bp, Artificial Sequence
  Description of Artificial Sequence: Synthetic oligonucleotide
gcctcccaggttcaagggat

SEQ ID NO: 4747 - DNA, 20 bp, Artificial Sequence
  Description of Artificial Sequence: Synthetic oligonucleotide
cctcccaggttcaagggatt

SEQ ID NO: 4748 - DNA, 20 bp, Artificial Sequence
  Description of Artificial Sequence: Synthetic oligonucleotide
ctcccaggttcaagggattc

SEQ ID NO: 4749 - DNA, 20 bp, Artificial Sequence
  Description of Artificial Sequence: Synthetic oligonucleotide
tcccaggttcaagggattct

SEQ ID NO: 4750 - DNA, 20 bp, Artificial Sequence
  Description of Artificial Sequence: Synthetic oligonucleotide
cccaggttcaagggattctc

SEQ ID NO: 4751 - DNA, 20 bp, Artificial Sequence
  Description of Artificial Sequence: Synthetic oligonucleotide
ccaggttcaagggattctca

SEQ ID NO: 4752 - DNA, 20 bp, Artificial Sequence
  Description of Artificial Sequence: Synthetic oligonucleotide
caggttcaagggattctcat

SEQ ID NO: 4753 - DNA, 20 bp, Artificial Sequence
  Description of Artificial Sequence: Synthetic oligonucleotide
aggttcaagggattctcatg

SEQ ID NO: 4754 - DNA, 20 bp, Artificial Sequence
  Description of Artificial Sequence: Synthetic oligonucleotide
ggttcaagggattctcatgc

SEQ ID NO: 4755 - DNA, 20 bp, Artificial Sequence
  Description of Artificial Sequence: Synthetic oligonucleotide
gttcaagggattctcatgcc

SEQ ID NO: 4756 - DNA, 20 bp, Artificial Sequence
  Description of Artificial Sequence: Synthetic oligonucleotide
ttcaagggattctcatgcct

SEQ ID NO: 4757 - DNA, 20 bp, Artificial Sequence
  Description of Artificial Sequence: Synthetic oligonucleotide
tcaagggattctcatgcctc

SEQ ID NO: 4758 - DNA, 20 bp, Artificial Sequence
  Description of Artificial Sequence: Synthetic oligonucleotide
caagggattctcatgcctca

SEQ ID NO: 4759 - DNA, 20 bp, Artificial Sequence
  Description of Artificial Sequence: Synthetic oligonucleotide
aagggattctcatgcctcag

SEQ ID NO: 4760 - DNA, 20 bp, Artificial Sequence
  Description of Artificial Sequence: Synthetic oligonucleotide
agggattctcatgcctcagc

SEQ ID NO: 4761 - DNA, 20 bp, Artificial Sequence
  Description of Artificial Sequence: Synthetic oligonucleotide
gggattctcatgcctcagcc

SEQ ID NO: 4762 - DNA, 20 bp, Artificial Sequence
  Description of Artificial Sequence: Synthetic oligonucleotide
ggattctcatgcctcagcct

SEQ ID NO: 4763 - DNA, 20 bp, Artificial Sequence
  Description of Artificial Sequence: Synthetic oligonucleotide
gattctcatgcctcagcctc

SEQ ID NO: 4764 - DNA, 20 bp, Artificial Sequence
  Description of Artificial Sequence: Synthetic oligonucleotide
attctcatgcctcagcctcc

SEQ ID NO: 4765 - DNA, 20 bp, Artificial Sequence
  Description of Artificial Sequence: Synthetic oligonucleotide
ttctcatgcctcagcctcct

SEQ ID NO: 4766 - DNA, 20 bp, Artificial Sequence
  Description of Artificial Sequence: Synthetic oligonucleotide
tctcatgcctcagcctcctg

SEQ ID NO: 4767 - DNA, 20 bp, Artificial Sequence
  Description of Artificial Sequence: Synthetic oligonucleotide
ctcatgcctcagcctcctga

SEQ ID NO: 4768 - DNA, 20 bp, Artificial Sequence
  Description of Artificial Sequence: Synthetic oligonucleotide
tcatgcctcagcctcctgag

SEQ ID NO: 4769 - DNA, 20 bp, Artificial Sequence
  Description of Artificial Sequence: Synthetic oligonucleotide
catgcctcagcctcctgagt

SEQ ID NO: 4770 - DNA, 20 bp, Artificial Sequence
  Description of Artificial Sequence: Synthetic oligonucleotide
atgcctcagcctcctgagta

SEQ ID NO: 4771 - DNA, 20 bp, Artificial Sequence
  Description of Artificial Sequence: Synthetic oligonucleotide
tgcctcagcctcctgagtag

SEQ ID NO: 4772 - DNA, 20 bp, Artificial Sequence
  Description of Artificial Sequence: Synthetic oligonucleotide
gcctcagcctcctgagtagc

SEQ ID NO: 4773 - DNA, 20 bp, Artificial Sequence
  Description of Artificial Sequence: Synthetic oligonucleotide
cctcagcctcctgagtagcc

SEQ ID NO: 4774 - DNA, 20 bp, Artificial Sequence
  Description of Artificial Sequence: Synthetic oligonucleotide
ctcagcctcctgagtagccg

SEQ ID NO: 4775 - DNA, 20 bp, Artificial Sequence
  Description of Artificial Sequence: Synthetic oligonucleotide
tcagcctcctgagtagccgg

SEQ ID NO: 4776 - DNA, 20 bp, Artificial Sequence
  Description of Artificial Sequence: Synthetic oligonucleotide
cagcctcctgagtagccggg

SEQ ID NO: 4777 - DNA, 20 bp, Artificial Sequence
  Description of Artificial Sequence: Synthetic oligonucleotide
agcctcctgagtagccggga

SEQ ID NO: 4778 - DNA, 20 bp, Artificial Sequence
  Description of Artificial Sequence: Synthetic oligonucleotide
gcctcctgagtagccgggat

SEQ ID NO: 4779 - DNA, 20 bp, Artificial Sequence
  Description of Artificial Sequence: Synthetic oligonucleotide
cctcctgagtagccgggatt

SEQ ID NO: 4780 - DNA, 20 bp, Artificial Sequence
  Description of Artificial Sequence: Synthetic oligonucleotide
ctcctgagtagccgggatta

SEQ ID NO: 4781 - DNA, 20 bp, Artificial Sequence
  Description of Artificial Sequence: Synthetic oligonucleotide
tcctgagtagccgggattac

SEQ ID NO: 4782 - DNA, 20 bp, Artificial Sequence
  Description of Artificial Sequence: Synthetic oligonucleotide
cctgagtagccgggattaca

SEQ ID NO: 4783 - DNA, 20 bp, Artificial Sequence
  Description of Artificial Sequence: Synthetic oligonucleotide
ctgagtagccgggattacag

SEQ ID NO: 4784 - DNA, 20 bp, Artificial Sequence
  Description of Artificial Sequence: Synthetic oligonucleotide
tgagtagccgggattacagg

SEQ ID NO: 4785 - DNA, 20 bp, Artificial Sequence
  Description of Artificial Sequence: Synthetic oligonucleotide
gagtagccgggattacaggc

SEQ ID NO: 4786 - DNA, 20 bp, Artificial Sequence
  Description of Artificial Sequence: Synthetic oligonucleotide
agtagccgggattacaggca

SEQ ID NO: 4787 - DNA, 20 bp, Artificial Sequence
  Description of Artificial Sequence: Synthetic oligonucleotide
gtagccgggattacaggcac

SEQ ID NO: 4788 - DNA, 20 bp, Artificial Sequence
  Description of Artificial Sequence: Synthetic oligonucleotide
tagccgggattacaggcacc

SEQ ID NO: 4789 - DNA, 20 bp, Artificial Sequence
  Description of Artificial Sequence: Synthetic oligonucleotide
agccgggattacaggcaccc

SEQ ID NO: 4790 - DNA, 20 bp, Artificial Sequence
  Description of Artificial Sequence: Synthetic oligonucleotide
gccgggattacaggcacccg

SEQ ID NO: 4791 - DNA, 20 bp, Artificial Sequence
  Description of Artificial Sequence: Synthetic oligonucleotide
ccgggattacaggcacccgc

SEQ ID NO: 4792 - DNA, 20 bp, Artificial Sequence
  Description of Artificial Sequence: Synthetic oligonucleotide
cgggattacaggcacccgcc

SEQ ID NO: 4793 - DNA, 20 bp, Artificial Sequence
  Description of Artificial Sequence: Synthetic oligonucleotide
gggattacaggcacccgcca

SEQ ID NO: 4794 - DNA, 20 bp, Artificial Sequence
  Description of Artificial Sequence: Synthetic oligonucleotide
ggattacaggcacccgccac

SEQ ID NO: 4795 - DNA, 20 bp, Artificial Sequence
  Description of Artificial Sequence: Synthetic oligonucleotide
gattacaggcacccgccacc

SEQ ID NO: 4796 - DNA, 20 bp, Artificial Sequence
  Description of Artificial Sequence: Synthetic oligonucleotide
attacaggcacccgccacca

SEQ ID NO: 4797 - DNA, 20 bp, Artificial Sequence
  Description of Artificial Sequence: Synthetic oligonucleotide
ttacaggcacccgccaccac

SEQ ID NO: 4798 - DNA, 20 bp, Artificial Sequence
  Description of Artificial Sequence: Synthetic oligonucleotide
tacaggcacccgccaccacg

SEQ ID NO: 4799 - DNA, 20 bp, Artificial Sequence
  Description of Artificial Sequence: Synthetic oligonucleotide
acaggcacccgccaccacgc

SEQ ID NO: 4800 - DNA, 20 bp, Artificial Sequence
  Description of Artificial Sequence: Synthetic oligonucleotide
caggcacccgccaccacgcc

SEQ ID NO: 4801 - DNA, 20 bp, Artificial Sequence
  Description of Artificial Sequence: Synthetic oligonucleotide
aggcacccgccaccacgcct

SEQ ID NO: 4802 - DNA, 20 bp, Artificial Sequence
  Description of Artificial Sequence: Synthetic oligonucleotide
ggcacccgccaccacgcctg

SEQ ID NO: 4803 - DNA, 20 bp, Artificial Sequence
  Description of Artificial Sequence: Synthetic oligonucleotide
gcacccgccaccacgcctgg

SEQ ID NO: 4804 - DNA, 20 bp, Artificial Sequence
  Description of Artificial Sequence: Synthetic oligonucleotide
cacccgccaccacgcctggc

SEQ ID NO: 4805 - DNA, 20 bp, Artificial Sequence
  Description of Artificial Sequence: Synthetic oligonucleotide
acccgccaccacgcctggct

SEQ ID NO: 4806 - DNA, 20 bp, Artificial Sequence
  Description of Artificial Sequence: Synthetic oligonucleotide
cccgccaccacgcctggcta

SEQ ID NO: 4807 - DNA, 20 bp, Artificial Sequence
  Description of Artificial Sequence: Synthetic oligonucleotide
ccgccaccacgcctggctag

SEQ ID NO: 4808 - DNA, 20 bp, Artificial Sequence
  Description of Artificial Sequence: Synthetic oligonucleotide
cgccaccacgcctggctagt

SEQ ID NO: 4809 - DNA, 20 bp, Artificial Sequence
  Description of Artificial Sequence: Synthetic oligonucleotide
gccaccacgcctggctagtt

SEQ ID NO: 4810 - DNA, 20 bp, Artificial Sequence
  Description of Artificial Sequence: Synthetic oligonucleotide
ccaccacgcctggctagttt

SEQ ID NO: 4811 - DNA, 20 bp, Artificial Sequence
  Description of Artificial Sequence: Synthetic oligonucleotide
caccacgcctggctagtttt

SEQ ID NO: 4812 - DNA, 20 bp, Artificial Sequence
  Description of Artificial Sequence: Synthetic oligonucleotide
accacgcctggctagttttt

SEQ ID NO: 4813 - DNA, 20 bp, Artificial Sequence
  Description of Artificial Sequence: Synthetic oligonucleotide
ccacgcctggctagtttttg

SEQ ID NO: 4814 - DNA, 20 bp, Artificial Sequence
  Description of Artificial Sequence: Synthetic oligonucleotide
cacgcctggctagtttttgt

SEQ ID NO: 4815 - DNA, 20 bp, Artificial Sequence
  Description of Artificial Sequence: Synthetic oligonucleotide
acgcctggctagtttttgta

SEQ ID NO: 4816 - DNA, 20 bp, Artificial Sequence
  Description of Artificial Sequence: Synthetic oligonucleotide
cgcctggctagtttttgtat

SEQ ID NO: 4817 - DNA, 20 bp, Artificial Sequence
  Description of Artificial Sequence: Synthetic oligonucleotide
gcctggctagtttttgtatt

SEQ ID NO: 4818 - DNA, 20 bp, Artificial Sequence
  Description of Artificial Sequence: Synthetic oligonucleotide
cctggctagtttttgtattt

SEQ ID NO: 4819 - DNA, 20 bp, Artificial Sequence
  Description of Artificial Sequence: Synthetic oligonucleotide
ctggctagtttttgtatttt

SEQ ID NO: 4820 - DNA, 20 bp, Artificial Sequence
  Description of Artificial Sequence: Synthetic oligonucleotide
tggctagtttttgtattttt

SEQ ID NO: 4821 - DNA, 20 bp, Artificial Sequence
  Description of Artificial Sequence: Synthetic oligonucleotide
ggctagtttttgtattttta

SEQ ID NO: 4822 - DNA, 20 bp, Artificial Sequence
  Description of Artificial Sequence: Synthetic oligonucleotide
gctagtttttgtatttttag

SEQ ID NO: 4823 - DNA, 20 bp, Artificial Sequence
  Description of Artificial Sequence: Synthetic oligonucleotide
ctagtttttgtatttttagt

SEQ ID NO: 4824 - DNA, 20 bp, Artificial Sequence
  Description of Artificial Sequence: Synthetic oligonucleotide
tagtttttgtatttttagta

SEQ ID NO: 4825 - DNA, 20 bp, Artificial Sequence
  Description of Artificial Sequence: Synthetic oligonucleotide
agtttttgtatttttagtag

SEQ ID NO: 4826 - DNA, 20 bp, Artificial Sequence
  Description of Artificial Sequence: Synthetic oligonucleotide
gtttttgtatttttagtagt

SEQ ID NO: 4827 - DNA, 20 bp, Artificial Sequence
  Description of Artificial Sequence: Synthetic oligonucleotide
tttttgtatttttagtagtg

SEQ ID NO: 4828 - DNA, 20 bp, Artificial Sequence
  Description of Artificial Sequence: Synthetic oligonucleotide
ttttgtatttttagtagtga

SEQ ID NO: 4829 - DNA, 20 bp, Artificial Sequence
  Description of Artificial Sequence: Synthetic oligonucleotide
tttgtatttttagtagtgag

SEQ ID NO: 4830 - DNA, 20 bp, Artificial Sequence
  Description of Artificial Sequence: Synthetic oligonucleotide
ttgtatttttagtagtgagg

SEQ ID NO: 4831 - DNA, 20 bp, Artificial Sequence
  Description of Artificial Sequence: Synthetic oligonucleotide
tgtatttttagtagtgaggg

SEQ ID NO: 4832 - DNA, 20 bp, Artificial Sequence
  Description of Artificial Sequence: Synthetic oligonucleotide
gtatttttagtagtgagggg

SEQ ID NO: 4833 - DNA, 20 bp, Artificial Sequence
  Description of Artificial Sequence: Synthetic oligonucleotide
tatttttagtagtgaggggg

SEQ ID NO: 4834 - DNA, 20 bp, Artificial Sequence
  Description of Artificial Sequence: Synthetic oligonucleotide
atttttagtagtgagggggt

SEQ ID NO: 4835 - DNA, 20 bp, Artificial Sequence
  Description of Artificial Sequence: Synthetic oligonucleotide
tttttagtagtgagggggtt

SEQ ID NO: 4836 - DNA, 20 bp, Artificial Sequence
  Description of Artificial Sequence: Synthetic oligonucleotide
ttttagtagtgagggggttt

SEQ ID NO: 4837 - DNA, 20 bp, Artificial Sequence
  Description of Artificial Sequence: Synthetic oligonucleotide
tttagtagtgagggggtttc

SEQ ID NO: 4838 - DNA, 20 bp, Artificial Sequence
  Description of Artificial Sequence: Synthetic oligonucleotide
ttagtagtgagggggtttca

SEQ ID NO: 4839 - DNA, 20 bp, Artificial Sequence
  Description of Artificial Sequence: Synthetic oligonucleotide
tagtagtgagggggtttcac

SEQ ID NO: 4840 - DNA, 20 bp, Artificial Sequence
  Description of Artificial Sequence: Synthetic oligonucleotide
agtagtgagggggtttcacc

SEQ ID NO: 4841 - DNA, 20 bp, Artificial Sequence
  Description of Artificial Sequence: Synthetic oligonucleotide
gtagtgagggggtttcacca

SEQ ID NO: 4842 - DNA, 20 bp, Artificial Sequence
  Description of Artificial Sequence: Synthetic oligonucleotide
tagtgagggggtttcaccat

SEQ ID NO: 4843 - DNA, 20 bp, Artificial Sequence
  Description of Artificial Sequence: Synthetic oligonucleotide
agtgagggggtttcaccatg

SEQ ID NO: 4844 - DNA, 20 bp, Artificial Sequence
  Description of Artificial Sequence: Synthetic oligonucleotide
gtgagggggtttcaccatgt

SEQ ID NO: 4845 - DNA, 20 bp, Artificial Sequence
  Description of Artificial Sequence: Synthetic oligonucleotide
tgagggggtttcaccatgtt

SEQ ID NO: 4846 - DNA, 20 bp, Artificial Sequence
  Description of Artificial Sequence: Synthetic oligonucleotide
gagggggtttcaccatgttg

SEQ ID NO: 4847 - DNA, 20 bp, Artificial Sequence
  Description of Artificial Sequence: Synthetic oligonucleotide
agggggtttcaccatgttgg

SEQ ID NO: 4848 - DNA, 20 bp, Artificial Sequence
  Description of Artificial Sequence: Synthetic oligonucleotide
gggggtttcaccatgttggc

SEQ ID NO: 4849 - DNA, 20 bp, Artificial Sequence
  Description of Artificial Sequence: Synthetic oligonucleotide
ggggtttcaccatgttggcc

SEQ ID NO: 4850 - DNA, 20 bp, Artificial Sequence
  Description of Artificial Sequence: Synthetic oligonucleotide
gggtttcaccatgttggcca

SEQ ID NO: 4851 - DNA, 20 bp, Artificial Sequence
  Description of Artificial Sequence: Synthetic oligonucleotide
ggtttcaccatgttggccag

SEQ ID NO: 4852 - DNA, 20 bp, Artificial Sequence
  Description of Artificial Sequence: Synthetic oligonucleotide
gtttcaccatgttggccagg

SEQ ID NO: 4853 - DNA, 20 bp, Artificial Sequence
  Description of Artificial Sequence: Synthetic oligonucleotide
tttcaccatgttggccaggt

SEQ ID NO: 4854 - DNA, 20 bp, Artificial Sequence
  Description of Artificial Sequence: Synthetic oligonucleotide
ttcaccatgttggccaggtt

SEQ ID NO: 4855 - DNA, 20 bp, Artificial Sequence
  Description of Artificial Sequence: Synthetic oligonucleotide
tcaccatgttggccaggttg

SEQ ID NO: 4856 - DNA, 20 bp, Artificial Sequence
  Description of Artificial Sequence: Synthetic oligonucleotide
caccatgttggccaggttgg

SEQ ID NO: 4857 - DNA, 20 bp, Artificial Sequence
  Description of Artificial Sequence: Synthetic oligonucleotide
accatgttggccaggttggt

SEQ ID NO: 4858 - DNA, 20 bp, Artificial Sequence
  Description of Artificial Sequence: Synthetic oligonucleotide
ccatgttggccaggttggtc

SEQ ID NO: 4859 - DNA, 20 bp, Artificial Sequence
  Description of Artificial Sequence: Synthetic oligonucleotide
catgttggccaggttggtct

SEQ ID NO: 4860 - DNA, 20 bp, Artificial Sequence
  Description of Artificial Sequence: Synthetic oligonucleotide
atgttggccaggttggtctc

SEQ ID NO: 4861 - DNA, 20 bp, Artificial Sequence
  Description of Artificial Sequence: Synthetic oligonucleotide
tgttggccaggttggtctca

SEQ ID NO: 4862 - DNA, 20 bp, Artificial Sequence
  Description of Artificial Sequence: Synthetic oligonucleotide
gttggccaggttggtctcaa

SEQ ID NO: 4863 - DNA, 20 bp, Artificial Sequence
  Description of Artificial Sequence: Synthetic oligonucleotide
ttggccaggttggtctcaaa

SEQ ID NO: 4864 - DNA, 20 bp, Artificial Sequence
  Description of Artificial Sequence: Synthetic oligonucleotide
tggccaggttggtctcaaac

SEQ ID NO: 4865 - DNA, 20 bp, Artificial Sequence
  Description of Artificial Sequence: Synthetic oligonucleotide
ggccaggttggtctcaaact

SEQ ID NO: 4866 - DNA, 20 bp, Artificial Sequence
  Description of Artificial Sequence: Synthetic oligonucleotide
gccaggttggtctcaaactc

SEQ ID NO: 4867 - DNA, 20 bp, Artificial Sequence
  Description of Artificial Sequence: Synthetic oligonucleotide
ccaggttggtctcaaactcc

SEQ ID NO: 4868 - DNA, 20 bp, Artificial Sequence
  Description of Artificial Sequence: Synthetic oligonucleotide
caggttggtctcaaactcct

SEQ ID NO: 4869 - DNA, 20 bp, Artificial Sequence
  Description of Artificial Sequence: Synthetic oligonucleotide
aggttggtctcaaactcctt

SEQ ID NO: 4870 - DNA, 20 bp, Artificial Sequence
  Description of Artificial Sequence: Synthetic oligonucleotide
ggttggtctcaaactcctta

SEQ ID NO: 4871 - DNA, 20 bp, Artificial Sequence
  Description of Artificial Sequence: Synthetic oligonucleotide
gttggtctcaaactccttac

SEQ ID NO: 4872 - DNA, 20 bp, Artificial Sequence
  Description of Artificial Sequence: Synthetic oligonucleotide
ttggtctcaaactccttacc

SEQ ID NO: 4873 - DNA, 20 bp, Artificial Sequence
  Description of Artificial Sequence: Synthetic oligonucleotide
tggtctcaaactccttacct

SEQ ID NO: 4874 - DNA, 20 bp, Artificial Sequence
  Description of Artificial Sequence: Synthetic oligonucleotide
ggtctcaaactccttacctc

SEQ ID NO: 4875 - DNA, 20 bp, Artificial Sequence
  Description of Artificial Sequence: Synthetic oligonucleotide
gtctcaaactccttacctca

SEQ ID NO: 4876 - DNA, 20 bp, Artificial Sequence
  Description of Artificial Sequence: Synthetic oligonucleotide
tctcaaactccttacctcat

SEQ ID NO: 4877 - DNA, 20 bp, Artificial Sequence
  Description of Artificial Sequence: Synthetic oligonucleotide
ctcaaactccttacctcatg

SEQ ID NO: 4878 - DNA, 20 bp, Artificial Sequence
  Description of Artificial Sequence: Synthetic oligonucleotide
tcaaactccttacctcatgt

SEQ ID NO: 4879 - DNA, 20 bp, Artificial Sequence
  Description of Artificial Sequence: Synthetic oligonucleotide
caaactccttacctcatgtg

SEQ ID NO: 4880 - DNA, 20 bp, Artificial Sequence
  Description of Artificial Sequence: Synthetic oligonucleotide
aaactccttacctcatgtga

SEQ ID NO: 4881 - DNA, 20 bp, Artificial Sequence
  Description of Artificial Sequence: Synthetic oligonucleotide
aactccttacctcatgtgat

SEQ ID NO: 4882 - DNA, 20 bp, Artificial Sequence
  Description of Artificial Sequence: Synthetic oligonucleotide
actccttacctcatgtgatc

SEQ ID NO: 4883 - DNA, 20 bp, Artificial Sequence
  Description of Artificial Sequence: Synthetic oligonucleotide
ctccttacctcatgtgatcc

SEQ ID NO: 4884 - DNA, 20 bp, Artificial Sequence
  Description of Artificial Sequence: Synthetic oligonucleotide
tccttacctcatgtgatcca

SEQ ID NO: 4885 - DNA, 20 bp, Artificial Sequence
  Description of Artificial Sequence: Synthetic oligonucleotide
ccttacctcatgtgatccac

SEQ ID NO: 4886 - DNA, 20 bp, Artificial Sequence
  Description of Artificial Sequence: Synthetic oligonucleotide
cttacctcatgtgatccacc

SEQ ID NO: 4887 - DNA, 20 bp, Artificial Sequence
  Description of Artificial Sequence: Synthetic oligonucleotide
ttacctcatgtgatccaccc

SEQ ID NO: 4888 - DNA, 20 bp, Artificial Sequence
  Description of Artificial Sequence: Synthetic oligonucleotide
tacctcatgtgatccaccct

SEQ ID NO: 4889 - DNA, 20 bp, Artificial Sequence
  Description of Artificial Sequence: Synthetic oligonucleotide
acctcatgtgatccaccctc

SEQ ID NO: 4890 - DNA, 20 bp, Artificial Sequence
  Description of Artificial Sequence: Synthetic oligonucleotide
cctcatgtgatccaccctcc

SEQ ID NO: 4891 - DNA, 20 bp, Artificial Sequence
  Description of Artificial Sequence: Synthetic oligonucleotide
ctcatgtgatccaccctcct

SEQ ID NO: 4892 - DNA, 20 bp, Artificial Sequence
  Description of Artificial Sequence: Synthetic oligonucleotide
tcatgtgatccaccctcctc

SEQ ID NO: 4893 - DNA, 20 bp, Artificial Sequence
  Description of Artificial Sequence: Synthetic oligonucleotide
catgtgatccaccctcctca

SEQ ID NO: 4894 - DNA, 20 bp, Artificial Sequence
  Description of Artificial Sequence: Synthetic oligonucleotide
atgtgatccaccctcctcag

SEQ ID NO: 4895 - DNA, 20 bp, Artificial Sequence
  Description of Artificial Sequence: Synthetic oligonucleotide
tgtgatccaccctcctcagc

SEQ ID NO: 4896 - DNA, 20 bp, Artificial Sequence
  Description of Artificial Sequence: Synthetic oligonucleotide
gtgatccaccctcctcagcc

SEQ ID NO: 4897 - DNA, 20 bp, Artificial Sequence
  Description of Artificial Sequence: Synthetic oligonucleotide
tgatccaccctcctcagcct

SEQ ID NO: 4898 - DNA, 20 bp, Artificial Sequence
  Description of Artificial Sequence: Synthetic oligonucleotide
gatccaccctcctcagcctc

SEQ ID NO: 4899 - DNA, 20 bp, Artificial Sequence
  Description of Artificial Sequence: Synthetic oligonucleotide
atccaccctcctcagcctcc

SEQ ID NO: 4900 - DNA, 20 bp, Artificial Sequence
  Description of Artificial Sequence: Synthetic oligonucleotide
tccaccctcctcagcctccc

SEQ ID NO: 4901 - DNA, 20 bp, Artificial Sequence
  Description of Artificial Sequence: Synthetic oligonucleotide
ccaccctcctcagcctccca

SEQ ID NO: 4902 - DNA, 20 bp, Artificial Sequence
  Description of Artificial Sequence: Synthetic oligonucleotide
caccctcctcagcctcccaa

SEQ ID NO: 4903 - DNA, 20 bp, Artificial Sequence
  Description of Artificial Sequence: Synthetic oligonucleotide
accctcctcagcctcccaaa

SEQ ID NO: 4904 - DNA, 20 bp, Artificial Sequence
  Description of Artificial Sequence: Synthetic oligonucleotide
ccctcctcagcctcccaaag

SEQ ID NO: 4905 - DNA, 20 bp, Artificial Sequence
  Description of Artificial Sequence: Synthetic oligonucleotide
cctcctcagcctcccaaagt

SEQ ID NO: 4906 - DNA, 20 bp, Artificial Sequence
  Description of Artificial Sequence: Synthetic oligonucleotide
ctcctcagcctcccaaagtg

SEQ ID NO: 4907 - DNA, 20 bp, Artificial Sequence
  Description of Artificial Sequence: Synthetic oligonucleotide
tcctcagcctcccaaagtgc

SEQ ID NO: 4908 - DNA, 20 bp, Artificial Sequence
  Description of Artificial Sequence: Synthetic oligonucleotide
cctcagcctcccaaagtgct

SEQ ID NO: 4909 - DNA, 20 bp, Artificial Sequence
  Description of Artificial Sequence: Synthetic oligonucleotide
ctcagcctcccaaagtgctg

SEQ ID NO: 4910 - DNA, 20 bp, Artificial Sequence
  Description of Artificial Sequence: Synthetic oligonucleotide
tcagcctcccaaagtgctgg

SEQ ID NO: 4911 - DNA, 20 bp, Artificial Sequence
  Description of Artificial Sequence: Synthetic oligonucleotide
cagcctcccaaagtgctggg

SEQ ID NO: 4912 - DNA, 20 bp, Artificial Sequence
  Description of Artificial Sequence: Synthetic oligonucleotide
agcctcccaaagtgctggga

SEQ ID NO: 4913 - DNA, 20 bp, Artificial Sequence
  Description of Artificial Sequence: Synthetic oligonucleotide
gcctcccaaagtgctgggat

SEQ ID NO: 4914 - DNA, 20 bp, Artificial Sequence
  Description of Artificial Sequence: Synthetic oligonucleotide
cctcccaaagtgctgggatt

SEQ ID NO: 4915 - DNA, 20 bp, Artificial Sequence
  Description of Artificial Sequence: Synthetic oligonucleotide
ctcccaaagtgctgggatta

SEQ ID NO: 4916 - DNA, 20 bp, Artificial Sequence
  Description of Artificial Sequence: Synthetic oligonucleotide
tcccaaagtgctgggattac

SEQ ID NO: 4917 - DNA, 20 bp, Artificial Sequence
  Description of Artificial Sequence: Synthetic oligonucleotide
cccaaagtgctgggattaca

SEQ ID NO: 4918 - DNA, 20 bp, Artificial Sequence
  Description of Artificial Sequence: Synthetic oligonucleotide
ccaaagtgctgggattacag

SEQ ID NO: 4919 - DNA, 20 bp, Artificial Sequence
  Description of Artificial Sequence: Synthetic oligonucleotide
caaagtgctgggattacagg

SEQ ID NO: 4920 - DNA, 20 bp, Artificial Sequence
  Description of Artificial Sequence: Synthetic oligonucleotide
aaagtgctgggattacaggt

SEQ ID NO: 4921 - DNA, 20 bp, Artificial Sequence
  Description of Artificial Sequence: Synthetic oligonucleotide
aagtgctgggattacaggta

SEQ ID NO: 4922 - DNA, 20 bp, Artificial Sequence
  Description of Artificial Sequence: Synthetic oligonucleotide
agtgctgggattacaggtat

SEQ ID NO: 4923 - DNA, 20 bp, Artificial Sequence
  Description of Artificial Sequence: Synthetic oligonucleotide
gtgctgggattacaggtatg

SEQ ID NO: 4924 - DNA, 20 bp, Artificial Sequence
  Description of Artificial Sequence: Synthetic oligonucleotide
tgctgggattacaggtatga

SEQ ID NO: 4925 - DNA, 20 bp, Artificial Sequence
  Description of Artificial Sequence: Synthetic oligonucleotide
gctgggattacaggtatgac

SEQ ID NO: 4926 - DNA, 20 bp, Artificial Sequence
  Description of Artificial Sequence: Synthetic oligonucleotide
ctgggattacaggtatgacc

SEQ ID NO: 4927 - DNA, 20 bp, Artificial Sequence
  Description of Artificial Sequence: Synthetic oligonucleotide
tgggattacaggtatgaccc

SEQ ID NO: 4928 - DNA, 20 bp, Artificial Sequence
  Description of Artificial Sequence: Synthetic oligonucleotide
gggattacaggtatgaccca

SEQ ID NO: 4929 - DNA, 20 bp, Artificial Sequence
  Description of Artificial Sequence: Synthetic oligonucleotide
ggattacaggtatgacccac

SEQ ID NO: 4930 - DNA, 20 bp, Artificial Sequence
  Description of Artificial Sequence: Synthetic oligonucleotide
gattacaggtatgacccact

SEQ ID NO: 4931 - DNA, 20 bp, Artificial Sequence
  Description of Artificial Sequence: Synthetic oligonucleotide
attacaggtatgacccactg

SEQ ID NO: 4932 - DNA, 20 bp, Artificial Sequence
  Description of Artificial Sequence: Synthetic oligonucleotide
ttacaggtatgacccactgc

SEQ ID NO: 4933 - DNA, 20 bp, Artificial Sequence
  Description of Artificial Sequence: Synthetic oligonucleotide
tacaggtatgacccactgcg

SEQ ID NO: 4934 - DNA, 20 bp, Artificial Sequence
  Description of Artificial Sequence: Synthetic oligonucleotide
acaggtatgacccactgcgc

SEQ ID NO: 4935 - DNA, 20 bp, Artificial Sequence
  Description of Artificial Sequence: Synthetic oligonucleotide
caggtatgacccactgcgcc

SEQ ID NO: 4936 - DNA, 20 bp, Artificial Sequence
  Description of Artificial Sequence: Synthetic oligonucleotide
aggtatgacccactgcgcct

SEQ ID NO: 4937 - DNA, 20 bp, Artificial Sequence
  Description of Artificial Sequence: Synthetic oligonucleotide
ggtatgacccactgcgcctg

SEQ ID NO: 4938 - DNA, 20 bp, Artificial Sequence
  Description of Artificial Sequence: Synthetic oligonucleotide
gtatgacccactgcgcctgg

SEQ ID NO: 4939 - DNA, 20 bp, Artificial Sequence
  Description of Artificial Sequence: Synthetic oligonucleotide
tatgacccactgcgcctggc

SEQ ID NO: 4940 - DNA, 20 bp, Artificial Sequence
  Description of Artificial Sequence: Synthetic oligonucleotide
atgacccactgcgcctggcc

SEQ ID NO: 4941 - DNA, 20 bp, Artificial Sequence
  Description of Artificial Sequence: Synthetic oligonucleotide
tgacccactgcgcctggcct

SEQ ID NO: 4942 - DNA, 20 bp, Artificial Sequence
  Description of Artificial Sequence: Synthetic oligonucleotide
gacccactgcgcctggccta

SEQ ID NO: 4943 - DNA, 20 bp, Artificial Sequence
  Description of Artificial Sequence: Synthetic oligonucleotide
acccactgcgcctggcctaa

SEQ ID NO: 4944 - DNA, 20 bp, Artificial Sequence
  Description of Artificial Sequence: Synthetic oligonucleotide
cccactgcgcctggcctaat

SEQ ID NO: 4945 - DNA, 20 bp, Artificial Sequence
  Description of Artificial Sequence: Synthetic oligonucleotide
ccactgcgcctggcctaatt

SEQ ID NO: 4946 - DNA, 20 bp, Artificial Sequence
  Description of Artificial Sequence: Synthetic oligonucleotide
cactgcgcctggcctaattt

SEQ ID NO: 4947 - DNA, 20 bp, Artificial Sequence
  Description of Artificial Sequence: Synthetic oligonucleotide
actgcgcctggcctaatttt

SEQ ID NO: 4948 - DNA, 20 bp, Artificial Sequence
  Description of Artificial Sequence: Synthetic oligonucleotide
ctgcgcctggcctaattttt

SEQ ID NO: 4949 - DNA, 20 bp, Artificial Sequence
  Description of Artificial Sequence: Synthetic oligonucleotide
tgcgcctggcctaatttttg

SEQ ID NO: 4950 - DNA, 20 bp, Artificial Sequence
  Description of Artificial Sequence: Synthetic oligonucleotide
gcgcctggcctaatttttgt

SEQ ID NO: 4951 - DNA, 20 bp, Artificial Sequence
  Description of Artificial Sequence: Synthetic oligonucleotide
cgcctggcctaatttttgta

SEQ ID NO: 4952 - DNA, 20 bp, Artificial Sequence
  Description of Artificial Sequence: Synthetic oligonucleotide
gcctggcctaatttttgtat

SEQ ID NO: 4953 - DNA, 20 bp, Artificial Sequence
  Description of Artificial Sequence: Synthetic oligonucleotide
cctggcctaatttttgtatt

SEQ ID NO: 4954 - DNA, 20 bp, Artificial Sequence
  Description of Artificial Sequence: Synthetic oligonucleotide
ctggcctaatttttgtattt

SEQ ID NO: 4955 - DNA, 20 bp, Artificial Sequence
  Description of Artificial Sequence: Synthetic oligonucleotide
tggcctaatttttgtatttt

SEQ ID NO: 4956 - DNA, 20 bp, Artificial Sequence
  Description of Artificial Sequence: Synthetic oligonucleotide
ggcctaatttttgtattttt

SEQ ID NO: 4957 - DNA, 20 bp, Artificial Sequence
  Description of Artificial Sequence: Synthetic oligonucleotide
gcctaatttttgtattttta

SEQ ID NO: 4958 - DNA, 20 bp, Artificial Sequence
  Description of Artificial Sequence: Synthetic oligonucleotide
cctaatttttgtatttttag

SEQ ID NO: 4959 - DNA, 20 bp, Artificial Sequence
  Description of Artificial Sequence: Synthetic oligonucleotide
ctaatttttgtatttttagt

SEQ ID NO: 4960 - DNA, 20 bp, Artificial Sequence
  Description of Artificial Sequence: Synthetic oligonucleotide
taatttttgtatttttagta

SEQ ID NO: 4961 - DNA, 20 bp, Artificial Sequence
  Description of Artificial Sequence: Synthetic oligonucleotide
aatttttgtatttttagtag

SEQ ID NO: 4962 - DNA, 20 bp, Artificial Sequence
  Description of Artificial Sequence: Synthetic oligonucleotide
atttttgtatttttagtaga

SEQ ID NO: 4963 - DNA, 20 bp, Artificial Sequence
  Description of Artificial Sequence: Synthetic oligonucleotide
tttttgtatttttagtagag

SEQ ID NO: 4964 - DNA, 20 bp, Artificial Sequence
  Description of Artificial Sequence: Synthetic oligonucleotide
ttttgtatttttagtagaga

SEQ ID NO: 4965 - DNA, 20 bp, Artificial Sequence
  Description of Artificial Sequence: Synthetic oligonucleotide
tttgtatttttagtagagac

SEQ ID NO: 4966 - DNA, 20 bp, Artificial Sequence
  Description of Artificial Sequence: Synthetic oligonucleotide
ttgtatttttagtagagaca

SEQ ID NO: 4967 - DNA, 20 bp, Artificial Sequence
  Description of Artificial Sequence: Synthetic oligonucleotide
tgtatttttagtagagacag

SEQ ID NO: 4968 - DNA, 20 bp, Artificial Sequence
  Description of Artificial Sequence: Synthetic oligonucleotide
gtatttttagtagagacagg

SEQ ID NO: 4969 - DNA, 20 bp, Artificial Sequence
  Description of Artificial Sequence: Synthetic oligonucleotide
tatttttagtagagacaggg

SEQ ID NO: 4970 - DNA, 20 bp, Artificial Sequence
  Description of Artificial Sequence: Synthetic oligonucleotide
atttttagtagagacagggt

SEQ ID NO: 4971 - DNA, 20 bp, Artificial Sequence
  Description of Artificial Sequence: Synthetic oligonucleotide
tttttagtagagacagggtt

SEQ ID NO: 4972 - DNA, 20 bp, Artificial Sequence
  Description of Artificial Sequence: Synthetic oligonucleotide
ttttagtagagacagggttt

SEQ ID NO: 4973 - DNA, 20 bp, Artificial Sequence
  Description of Artificial Sequence: Synthetic oligonucleotide
tttagtagagacagggtttc

SEQ ID NO: 4974 - DNA, 20 bp, Artificial Sequence
  Description of Artificial Sequence: Synthetic oligonucleotide
ttagtagagacagggtttca

SEQ ID NO: 4975 - DNA, 20 bp, Artificial Sequence
  Description of Artificial Sequence: Synthetic oligonucleotide
tagtagagacagggtttcac

SEQ ID NO: 4976 - DNA, 20 bp, Artificial Sequence
  Description of Artificial Sequence: Synthetic oligonucleotide
agtagagacagggtttcacc

SEQ ID NO: 4977 - DNA, 20 bp, Artificial Sequence
  Description of Artificial Sequence: Synthetic oligonucleotide
gtagagacagggtttcacca

SEQ ID NO: 4978 - DNA, 20 bp, Artificial Sequence
  Description of Artificial Sequence: Synthetic oligonucleotide
tagagacagggtttcaccat

SEQ ID NO: 4979 - DNA, 20 bp, Artificial Sequence
  Description of Artificial Sequence: Synthetic oligonucleotide
agagacagggtttcaccatg

SEQ ID NO: 4980 - DNA, 20 bp, Artificial Sequence
  Description of Artificial Sequence: Synthetic oligonucleotide
gagacagggtttcaccatgt

SEQ ID NO: 4981 - DNA, 20 bp, Artificial Sequence
  Description of Artificial Sequence: Synthetic oligonucleotide
agacagggtttcaccatgtt

SEQ ID NO: 4982 - DNA, 20 bp, Artificial Sequence
  Description of Artificial Sequence: Synthetic oligonucleotide
gacagggtttcaccatgttg

SEQ ID NO: 4983 - DNA, 20 bp, Artificial Sequence
  Description of Artificial Sequence: Synthetic oligonucleotide
acagggtttcaccatgttgg

SEQ ID NO: 4984 - DNA, 20 bp, Artificial Sequence
  Description of Artificial Sequence: Synthetic oligonucleotide
cagggtttcaccatgttggc

SEQ ID NO: 4985 - DNA, 20 bp, Artificial Sequence
  Description of Artificial Sequence: Synthetic oligonucleotide
agggtttcaccatgttggcc

SEQ ID NO: 4986 - DNA, 20 bp, Artificial Sequence
  Description of Artificial Sequence: Synthetic oligonucleotide
gggtttcaccatgttggcca

SEQ ID NO: 4987 - DNA, 20 bp, Artificial Sequence
  Description of Artificial Sequence: Synthetic oligonucleotide
ggtttcaccatgttggccag

SEQ ID NO: 4988 - DNA, 20 bp, Artificial Sequence
  Description of Artificial Sequence: Synthetic oligonucleotide
gtttcaccatgttggccagg

SEQ ID NO: 4989 - DNA, 20 bp, Artificial Sequence
  Description of Artificial Sequence: Synthetic oligonucleotide
tttcaccatgttggccaggc

SEQ ID NO: 4990 - DNA, 20 bp, Artificial Sequence
  Description of Artificial Sequence: Synthetic oligonucleotide
ttcaccatgttggccaggct

SEQ ID NO: 4991 - DNA, 20 bp, Artificial Sequence
  Description of Artificial Sequence: Synthetic oligonucleotide
tcaccatgttggccaggcta

SEQ ID NO: 4992 - DNA, 20 bp, Artificial Sequence
  Description of Artificial Sequence: Synthetic oligonucleotide
caccatgttggccaggctag

SEQ ID NO: 4993 - DNA, 20 bp, Artificial Sequence
  Description of Artificial Sequence: Synthetic oligonucleotide
accatgttggccaggctagt

SEQ ID NO: 4994 - DNA, 20 bp, Artificial Sequence
  Description of Artificial Sequence: Synthetic oligonucleotide
ccatgttggccaggctagtt

SEQ ID NO: 4995 - DNA, 20 bp, Artificial Sequence
  Description of Artificial Sequence: Synthetic oligonucleotide
catgttggccaggctagttt

SEQ ID NO: 4996 - DNA, 20 bp, Artificial Sequence
  Description of Artificial Sequence: Synthetic oligonucleotide
atgttggccaggctagtttt

SEQ ID NO: 4997 - DNA, 20 bp, Artificial Sequence
  Description of Artificial Sequence: Synthetic oligonucleotide
tgttggccaggctagttttg

SEQ ID NO: 4998 - DNA, 20 bp, Artificial Sequence
  Description of Artificial Sequence: Synthetic oligonucleotide
gttggccaggctagttttga

SEQ ID NO: 4999 - DNA, 20 bp, Artificial Sequence
  Description of Artificial Sequence: Synthetic oligonucleotide
ttggccaggctagttttgaa

SEQ ID NO: 5000 - DNA, 20 bp, Artificial Sequence
  Description of Artificial Sequence: Synthetic oligonucleotide
tggccaggctagttttgaac

SEQ ID NO: 5001 - DNA, 20 bp, Artificial Sequence
  Description of Artificial Sequence: Synthetic oligonucleotide
ggccaggctagttttgaact

SEQ ID NO: 5002 - DNA, 20 bp, Artificial Sequence
  Description of Artificial Sequence: Synthetic oligonucleotide
gccaggctagttttgaactc

SEQ ID NO: 5003 - DNA, 20 bp, Artificial Sequence
  Description of Artificial Sequence: Synthetic oligonucleotide
ccaggctagttttgaactcc

SEQ ID NO: 5004 - DNA, 20 bp, Artificial Sequence
  Description of Artificial Sequence: Synthetic oligonucleotide
caggctagttttgaactcct

SEQ ID NO: 5005 - DNA, 20 bp, Artificial Sequence
  Description of Artificial Sequence: Synthetic oligonucleotide
aggctagttttgaactcctg

SEQ ID NO: 5006 - DNA, 20 bp, Artificial Sequence
  Description of Artificial Sequence: Synthetic oligonucleotide
ggctagttttgaactcctga

SEQ ID NO: 5007 - DNA, 20 bp, Artificial Sequence
  Description of Artificial Sequence: Synthetic oligonucleotide
gctagttttgaactcctgac

SEQ ID NO: 5008 - DNA, 20 bp, Artificial Sequence
  Description of Artificial Sequence: Synthetic oligonucleotide
ctagttttgaactcctgacc

SEQ ID NO: 5009 - DNA, 20 bp, Artificial Sequence
  Description of Artificial Sequence: Synthetic oligonucleotide
tagttttgaactcctgacct

SEQ ID NO: 5010 - DNA, 20 bp, Artificial Sequence
  Description of Artificial Sequence: Synthetic oligonucleotide
agttttgaactcctgacctc

SEQ ID NO: 5011 - DNA, 20 bp, Artificial Sequence
  Description of Artificial Sequence: Synthetic oligonucleotide
gttttgaactcctgacctca

SEQ ID NO: 5012 - DNA, 20 bp, Artificial Sequence
  Description of Artificial Sequence: Synthetic oligonucleotide
ttttgaactcctgacctcag

SEQ ID NO: 5013 - DNA, 20 bp, Artificial Sequence
  Description of Artificial Sequence: Synthetic oligonucleotide
tttgaactcctgacctcagg

SEQ ID NO: 5014 - DNA, 20 bp, Artificial Sequence
  Description of Artificial Sequence: Synthetic oligonucleotide
ttgaactcctgacctcaggt

SEQ ID NO: 5015 - DNA, 20 bp, Artificial Sequence
  Description of Artificial Sequence: Synthetic oligonucleotide
tgaactcctgacctcaggtg

SEQ ID NO: 5016 - DNA, 20 bp, Artificial Sequence
  Description of Artificial Sequence: Synthetic oligonucleotide
gaactcctgacctcaggtga

SEQ ID NO: 5017 - DNA, 20 bp, Artificial Sequence
  Description of Artificial Sequence: Synthetic oligonucleotide
aactcctgacctcaggtgat

SEQ ID NO: 5018 - DNA, 20 bp, Artificial Sequence
  Description of Artificial Sequence: Synthetic oligonucleotide
actcctgacctcaggtgatc

SEQ ID NO: 5019 - DNA, 20 bp, Artificial Sequence
  Description of Artificial Sequence: Synthetic oligonucleotide
ctcctgacctcaggtgatcc

SEQ ID NO: 5020 - DNA, 20 bp, Artificial Sequence
  Description of Artificial Sequence: Synthetic oligonucleotide
tcctgacctcaggtgatcca

SEQ ID NO: 5021 - DNA, 20 bp, Artificial Sequence
  Description of Artificial Sequence: Synthetic oligonucleotide
cctgacctcaggtgatccac

SEQ ID NO: 5022 - DNA, 20 bp, Artificial Sequence
  Description of Artificial Sequence: Synthetic oligonucleotide
ctgacctcaggtgatccacc

SEQ ID NO: 5023 - DNA, 20 bp, Artificial Sequence
  Description of Artificial Sequence: Synthetic oligonucleotide
tgacctcaggtgatccaccc

SEQ ID NO: 5024 - DNA, 20 bp, Artificial Sequence
  Description of Artificial Sequence: Synthetic oligonucleotide
gacctcaggtgatccaccca

SEQ ID NO: 5025 - DNA, 20 bp, Artificial Sequence
  Description of Artificial Sequence: Synthetic oligonucleotide
acctcaggtgatccacccac

SEQ ID NO: 5026 - DNA, 20 bp, Artificial Sequence
  Description of Artificial Sequence: Synthetic oligonucleotide
cctcaggtgatccacccacc

SEQ ID NO: 5027 - DNA, 20 bp, Artificial Sequence
  Description of Artificial Sequence: Synthetic oligonucleotide
ctcaggtgatccacccacct

SEQ ID NO: 5028 - DNA, 20 bp, Artificial Sequence
  Description of Artificial Sequence: Synthetic oligonucleotide
tcaggtgatccacccacctc

SEQ ID NO: 5029 - DNA, 20 bp, Artificial Sequence
  Description of Artificial Sequence: Synthetic oligonucleotide
caggtgatccacccacctcg

SEQ ID NO: 5030 - DNA, 20 bp, Artificial Sequence
  Description of Artificial Sequence: Synthetic oligonucleotide
aggtgatccacccacctcgg

SEQ ID NO: 5031 - DNA, 20 bp, Artificial Sequence
  Description of Artificial Sequence: Synthetic oligonucleotide
ggtgatccacccacctcggc

SEQ ID NO: 5032 - DNA, 20 bp, Artificial Sequence
  Description of Artificial Sequence: Synthetic oligonucleotide
gtgatccacccacctcggcc

SEQ ID NO: 5033 - DNA, 20 bp, Artificial Sequence
  Description of Artificial Sequence: Synthetic oligonucleotide
tgatccacccacctcggcct

SEQ ID NO: 5034 - DNA, 20 bp, Artificial Sequence
  Description of Artificial Sequence: Synthetic oligonucleotide
gatccacccacctcggcctc

SEQ ID NO: 5035 - DNA, 20 bp, Artificial Sequence
  Description of Artificial Sequence: Synthetic oligonucleotide
atccacccacctcggcctcc

SEQ ID NO: 5036 - DNA, 20 bp, Artificial Sequence
  Description of Artificial Sequence: Synthetic oligonucleotide
tccacccacctcggcctccc

SEQ ID NO: 5037 - DNA, 20 bp, Artificial Sequence
  Description of Artificial Sequence: Synthetic oligonucleotide
ccacccacctcggcctccca

SEQ ID NO: 5038 - DNA, 20 bp, Artificial Sequence
  Description of Artificial Sequence: Synthetic oligonucleotide
cacccacctcggcctcccaa

SEQ ID NO: 5039 - DNA, 20 bp, Artificial Sequence
  Description of Artificial Sequence: Synthetic oligonucleotide
acccacctcggcctcccaaa

SEQ ID NO: 5040 - DNA, 20 bp, Artificial Sequence
  Description of Artificial Sequence: Synthetic oligonucleotide
cccacctcggcctcccaaag

SEQ ID NO: 5041 - DNA, 20 bp, Artificial Sequence
  Description of Artificial Sequence: Synthetic oligonucleotide
ccacctcggcctcccaaagt

SEQ ID NO: 5042 - DNA, 20 bp, Artificial Sequence
  Description of Artificial Sequence: Synthetic oligonucleotide
cacctcggcctcccaaagtg

SEQ ID NO: 5043 - DNA, 20 bp, Artificial Sequence
  Description of Artificial Sequence: Synthetic oligonucleotide
acctcggcctcccaaagtgc

SEQ ID NO: 5044 - DNA, 20 bp, Artificial Sequence
  Description of Artificial Sequence: Synthetic oligonucleotide
cctcggcctcccaaagtgct

SEQ ID NO: 5045 - DNA, 20 bp, Artificial Sequence
  Description of Artificial Sequence: Synthetic oligonucleotide
ctcggcctcccaaagtgctg

SEQ ID NO: 5046 - DNA, 20 bp, Artificial Sequence
  Description of Artificial Sequence: Synthetic oligonucleotide
tcggcctcccaaagtgctgg

SEQ ID NO: 5047 - DNA, 20 bp, Artificial Sequence
  Description of Artificial Sequence: Synthetic oligonucleotide
cggcctcccaaagtgctggg

SEQ ID NO: 5048 - DNA, 20 bp, Artificial Sequence
  Description of Artificial Sequence: Synthetic oligonucleotide
ggcctcccaaagtgctggga

SEQ ID NO: 5049 - DNA, 20 bp, Artificial Sequence
  Description of Artificial Sequence: Synthetic oligonucleotide
gcctcccaaagtgctgggat

SEQ ID NO: 5050 - DNA, 20 bp, Artificial Sequence
  Description of Artificial Sequence: Synthetic oligonucleotide
cctcccaaagtgctgggatt

SEQ ID NO: 5051 - DNA, 20 bp, Artificial Sequence
  Description of Artificial Sequence: Synthetic oligonucleotide
ctcccaaagtgctgggatta

SEQ ID NO: 5052 - DNA, 20 bp, Artificial Sequence
  Description of Artificial Sequence: Synthetic oligonucleotide
tcccaaagtgctgggattac

SEQ ID NO: 5053 - DNA, 20 bp, Artificial Sequence
  Description of Artificial Sequence: Synthetic oligonucleotide
cccaaagtgctgggattaca

SEQ ID NO: 5054 - DNA, 20 bp, Artificial Sequence
  Description of Artificial Sequence: Synthetic oligonucleotide
ccaaagtgctgggattacag

SEQ ID NO: 5055 - DNA, 20 bp, Artificial Sequence
  Description of Artificial Sequence: Synthetic oligonucleotide
caaagtgctgggattacagg

SEQ ID NO: 5056 - DNA, 20 bp, Artificial Sequence
  Description of Artificial Sequence: Synthetic oligonucleotide
aaagtgctgggattacaggt

SEQ ID NO: 5057 - DNA, 20 bp, Artificial Sequence
  Description of Artificial Sequence: Synthetic oligonucleotide
aagtgctgggattacaggtg

SEQ ID NO: 5058 - DNA, 20 bp, Artificial Sequence
  Description of Artificial Sequence: Synthetic oligonucleotide
agtgctgggattacaggtgt

SEQ ID NO: 5059 - DNA, 20 bp, Artificial Sequence
  Description of Artificial Sequence: Synthetic oligonucleotide
gtgctgggattacaggtgtg

SEQ ID NO: 5060 - DNA, 20 bp, Artificial Sequence
  Description of Artificial Sequence: Synthetic oligonucleotide
tgctgggattacaggtgtga

SEQ ID NO: 5061 - DNA, 20 bp, Artificial Sequence
  Description of Artificial Sequence: Synthetic oligonucleotide
gctgggattacaggtgtgag

SEQ ID NO: 5062 - DNA, 20 bp, Artificial Sequence
  Description of Artificial Sequence: Synthetic oligonucleotide
ctgggattacaggtgtgagc

SEQ ID NO: 5063 - DNA, 20 bp, Artificial Sequence
  Description of Artificial Sequence: Synthetic oligonucleotide
tgggattacaggtgtgagcc

SEQ ID NO: 5064 - DNA, 20 bp, Artificial Sequence
  Description of Artificial Sequence: Synthetic oligonucleotide
gggattacaggtgtgagccc

SEQ ID NO: 5065 - DNA, 20 bp, Artificial Sequence
  Description of Artificial Sequence: Synthetic oligonucleotide
ggattacaggtgtgagcccc

SEQ ID NO: 5066 - DNA, 20 bp, Artificial Sequence
  Description of Artificial Sequence: Synthetic oligonucleotide
gattacaggtgtgagccccc

SEQ ID NO: 5067 - DNA, 20 bp, Artificial Sequence
  Description of Artificial Sequence: Synthetic oligonucleotide
attacaggtgtgagccccca

SEQ ID NO: 5068 - DNA, 20 bp, Artificial Sequence
  Description of Artificial Sequence: Synthetic oligonucleotide
ttacaggtgtgagcccccac

SEQ ID NO: 5069 - DNA, 20 bp, Artificial Sequence
  Description of Artificial Sequence: Synthetic oligonucleotide
tacaggtgtgagcccccaca

SEQ ID NO: 5070 - DNA, 20 bp, Artificial Sequence
  Description of Artificial Sequence: Synthetic oligonucleotide
acaggtgtgagcccccacac

SEQ ID NO: 5071 - DNA, 20 bp, Artificial Sequence
  Description of Artificial Sequence: Synthetic oligonucleotide
caggtgtgagcccccacacc

SEQ ID NO: 5072 - DNA, 20 bp, Artificial Sequence
  Description of Artificial Sequence: Synthetic oligonucleotide
aggtgtgagcccccacaccc

SEQ ID NO: 5073 - DNA, 20 bp, Artificial Sequence
  Description of Artificial Sequence: Synthetic oligonucleotide
ggtgtgagcccccacacccg

SEQ ID NO: 5074 - DNA, 20 bp, Artificial Sequence
  Description of Artificial Sequence: Synthetic oligonucleotide
gtgtgagcccccacacccgg

SEQ ID NO: 5075 - DNA, 20 bp, Artificial Sequence
  Description of Artificial Sequence: Synthetic oligonucleotide
tgtgagcccccacacccggc

SEQ ID NO: 5076 - DNA, 20 bp, Artificial Sequence
  Description of Artificial Sequence: Synthetic oligonucleotide
gtgagcccccacacccggcc

SEQ ID NO: 5077 - DNA, 20 bp, Artificial Sequence
  Description of Artificial Sequence: Synthetic oligonucleotide
tgagcccccacacccggcct

SEQ ID NO: 5078 - DNA, 20 bp, Artificial Sequence
  Description of Artificial Sequence: Synthetic oligonucleotide
gagcccccacacccggcctt

SEQ ID NO: 5079 - DNA, 20 bp, Artificial Sequence
  Description of Artificial Sequence: Synthetic oligonucleotide
agcccccacacccggcctta

SEQ ID NO: 5080 - DNA, 20 bp, Artificial Sequence
  Description of Artificial Sequence: Synthetic oligonucleotide
gcccccacacccggccttat

SEQ ID NO: 5081 - DNA, 20 bp, Artificial Sequence
  Description of Artificial Sequence: Synthetic oligonucleotide
cccccacacccggccttatt

SEQ ID NO: 5082 - DNA, 20 bp, Artificial Sequence
  Description of Artificial Sequence: Synthetic oligonucleotide
ccccacacccggccttattt

SEQ ID NO: 5083 - DNA, 20 bp, Artificial Sequence
  Description of Artificial Sequence: Synthetic oligonucleotide
cccacacccggccttatttt

SEQ ID NO: 5084 - DNA, 20 bp, Artificial Sequence
  Description of Artificial Sequence: Synthetic oligonucleotide
ccacacccggccttattttt

SEQ ID NO: 5085 - DNA, 20 bp, Artificial Sequence
  Description of Artificial Sequence: Synthetic oligonucleotide
cacacccggccttattttta

SEQ ID NO: 5086 - DNA, 20 bp, Artificial Sequence
  Description of Artificial Sequence: Synthetic oligonucleotide
acacccggccttatttttaa

SEQ ID NO: 5087 - DNA, 20 bp, Artificial Sequence
  Description of Artificial Sequence: Synthetic oligonucleotide
cacccggccttatttttaag

SEQ ID NO: 5088 - DNA, 20 bp, Artificial Sequence
  Description of Artificial Sequence: Synthetic oligonucleotide
acccggccttatttttaagt

SEQ ID NO: 5089 - DNA, 20 bp, Artificial Sequence
  Description of Artificial Sequence: Synthetic oligonucleotide
cccggccttatttttaagtt

SEQ ID NO: 5090 - DNA, 20 bp, Artificial Sequence
  Description of Artificial Sequence: Synthetic oligonucleotide
ccggccttatttttaagttt

SEQ ID NO: 5091 - DNA, 20 bp, Artificial Sequence
  Description of Artificial Sequence: Synthetic oligonucleotide
cggccttatttttaagttta

SEQ ID NO: 5092 - DNA, 20 bp, Artificial Sequence
  Description of Artificial Sequence: Synthetic oligonucleotide
ggccttatttttaagtttaa

SEQ ID NO: 5093 - DNA, 20 bp, Artificial Sequence
  Description of Artificial Sequence: Synthetic oligonucleotide
gccttatttttaagtttaaa

SEQ ID NO: 5094 - DNA, 20 bp, Artificial Sequence
  Description of Artificial Sequence: Synthetic oligonucleotide
ccttatttttaagtttaaaa

SEQ ID NO: 5095 - DNA, 20 bp, Artificial Sequence
  Description of Artificial Sequence: Synthetic oligonucleotide
cttatttttaagtttaaaaa

SEQ ID NO: 5096 - DNA, 20 bp, Artificial Sequence
  Description of Artificial Sequence: Synthetic oligonucleotide
ttatttttaagtttaaaaac

SEQ ID NO: 5097 - DNA, 20 bp, Artificial Sequence
  Description of Artificial Sequence: Synthetic oligonucleotide
tatttttaagtttaaaaaca

SEQ ID NO: 5098 - DNA, 20 bp, Artificial Sequence
  Description of Artificial Sequence: Synthetic oligonucleotide
atttttaagtttaaaaacaa

SEQ ID NO: 5099 - DNA, 20 bp, Artificial Sequence
  Description of Artificial Sequence: Synthetic oligonucleotide
tttttaagtttaaaaacaat

SEQ ID NO: 5100 - DNA, 20 bp, Artificial Sequence
  Description of Artificial Sequence: Synthetic oligonucleotide
ttttaagtttaaaaacaatt

SEQ ID NO: 5101 - DNA, 20 bp, Artificial Sequence
  Description of Artificial Sequence: Synthetic oligonucleotide
tttaagtttaaaaacaattt

SEQ ID NO: 5102 - DNA, 20 bp, Artificial Sequence
  Description of Artificial Sequence: Synthetic oligonucleotide
ttaagtttaaaaacaatttt

SEQ ID NO: 5103 - DNA, 20 bp, Artificial Sequence
  Description of Artificial Sequence: Synthetic oligonucleotide
taagtttaaaaacaattttt

SEQ ID NO: 5104 - DNA, 20 bp, Artificial Sequence
  Description of Artificial Sequence: Synthetic oligonucleotide
aagtttaaaaacaatttttt

SEQ ID NO: 5105 - DNA, 20 bp, Artificial Sequence
  Description of Artificial Sequence: Synthetic oligonucleotide
agtttaaaaacaattttttt

SEQ ID NO: 5106 - DNA, 20 bp, Artificial Sequence
  Description of Artificial Sequence: Synthetic oligonucleotide
gtttaaaaacaatttttttt

SEQ ID NO: 5107 - DNA, 20 bp, Artificial Sequence
  Description of Artificial Sequence: Synthetic oligonucleotide
tttaaaaacaattttttttg

SEQ ID NO: 5108 - DNA, 20 bp, Artificial Sequence
  Description of Artificial Sequence: Synthetic oligonucleotide
ttaaaaacaattttttttga

SEQ ID NO: 5109 - DNA, 20 bp, Artificial Sequence
  Description of Artificial Sequence: Synthetic oligonucleotide
taaaaacaattttttttgag

SEQ ID NO: 5110 - DNA, 20 bp, Artificial Sequence
  Description of Artificial Sequence: Synthetic oligonucleotide
aaaaacaattttttttgaga

SEQ ID NO: 5111 - DNA, 20 bp, Artificial Sequence
  Description of Artificial Sequence: Synthetic oligonucleotide
aaaacaattttttttgagac

SEQ ID NO: 5112 - DNA, 20 bp, Artificial Sequence
  Description of Artificial Sequence: Synthetic oligonucleotide
aaacaattttttttgagaca

SEQ ID NO: 5113 - DNA, 20 bp, Artificial Sequence
  Description of Artificial Sequence: Synthetic oligonucleotide
aacaattttttttgagacag

SEQ ID NO: 5114 - DNA, 20 bp, Artificial Sequence
  Description of Artificial Sequence: Synthetic oligonucleotide
acaattttttttgagacagg

SEQ ID NO: 5115 - DNA, 20 bp, Artificial Sequence
  Description of Artificial Sequence: Synthetic oligonucleotide
caattttttttgagacaggg

SEQ ID NO: 5116 - DNA, 20 bp, Artificial Sequence
  Description of Artificial Sequence: Synthetic oligonucleotide
aattttttttgagacagggc

SEQ ID NO: 5117 - DNA, 20 bp, Artificial Sequence
  Description of Artificial Sequence: Synthetic oligonucleotide
attttttttgagacagggcc

SEQ ID NO: 5118 - DNA, 20 bp, Artificial Sequence
  Description of Artificial Sequence: Synthetic oligonucleotide
ttttttttgagacagggcct

SEQ ID NO: 5119 - DNA, 20 bp, Artificial Sequence
  Description of Artificial Sequence: Synthetic oligonucleotide
tttttttgagacagggcctg

SEQ ID NO: 5120 - DNA, 20 bp, Artificial Sequence
  Description of Artificial Sequence: Synthetic oligonucleotide
ttttttgagacagggcctgg

SEQ ID NO: 5121 - DNA, 20 bp, Artificial Sequence
  Description of Artificial Sequence: Synthetic oligonucleotide
tttttgagacagggcctggc

SEQ ID NO: 5122 - DNA, 20 bp, Artificial Sequence
  Description of Artificial Sequence: Synthetic oligonucleotide
ttttgagacagggcctggct

SEQ ID NO: 5123 - DNA, 20 bp, Artificial Sequence
  Description of Artificial Sequence: Synthetic oligonucleotide
tttgagacagggcctggctc

SEQ ID NO: 5124 - DNA, 20 bp, Artificial Sequence
  Description of Artificial Sequence: Synthetic oligonucleotide
ttgagacagggcctggctcc

SEQ ID NO: 5125 - DNA, 20 bp, Artificial Sequence
  Description of Artificial Sequence: Synthetic oligonucleotide
tgagacagggcctggctcca

SEQ ID NO: 5126 - DNA, 20 bp, Artificial Sequence
  Description of Artificial Sequence: Synthetic oligonucleotide
gagacagggcctggctccat

SEQ ID NO: 5127 - DNA, 20 bp, Artificial Sequence
  Description of Artificial Sequence: Synthetic oligonucleotide
agacagggcctggctccatt

SEQ ID NO: 5128 - DNA, 20 bp, Artificial Sequence
  Description of Artificial Sequence: Synthetic oligonucleotide
gacagggcctggctccattg

SEQ ID NO: 5129 - DNA, 20 bp, Artificial Sequence
  Description of Artificial Sequence: Synthetic oligonucleotide
acagggcctggctccattgc

SEQ ID NO: 5130 - DNA, 20 bp, Artificial Sequence
  Description of Artificial Sequence: Synthetic oligonucleotide
cagggcctggctccattgcc

SEQ ID NO: 5131 - DNA, 20 bp, Artificial Sequence
  Description of Artificial Sequence: Synthetic oligonucleotide
agggcctggctccattgccc

SEQ ID NO: 5132 - DNA, 20 bp, Artificial Sequence
  Description of Artificial Sequence: Synthetic oligonucleotide
gggcctggctccattgccca

SEQ ID NO: 5133 - DNA, 20 bp, Artificial Sequence
  Description of Artificial Sequence: Synthetic oligonucleotide
ggcctggctccattgcccag

SEQ ID NO: 5134 - DNA, 20 bp, Artificial Sequence
  Description of Artificial Sequence: Synthetic oligonucleotide
gcctggctccattgcccagg

SEQ ID NO: 5135 - DNA, 20 bp, Artificial Sequence
  Description of Artificial Sequence: Synthetic oligonucleotide
cctggctccattgcccaggc

SEQ ID NO: 5136 - DNA, 20 bp, Artificial Sequence
  Description of Artificial Sequence: Synthetic oligonucleotide
ctggctccattgcccaggct

SEQ ID NO: 5137 - DNA, 20 bp, Artificial Sequence
  Description of Artificial Sequence: Synthetic oligonucleotide
tggctccattgcccaggctg

SEQ ID NO: 5138 - DNA, 20 bp, Artificial Sequence
  Description of Artificial Sequence: Synthetic oligonucleotide
ggctccattgcccaggctgg

SEQ ID NO: 5139 - DNA, 20 bp, Artificial Sequence
  Description of Artificial Sequence: Synthetic oligonucleotide
gctccattgcccaggctgga

SEQ ID NO: 5140 - DNA, 20 bp, Artificial Sequence
  Description of Artificial Sequence: Synthetic oligonucleotide
ctccattgcccaggctggag

SEQ ID NO: 5141 - DNA, 20 bp, Artificial Sequence
  Description of Artificial Sequence: Synthetic oligonucleotide
tccattgcccaggctggagt

SEQ ID NO: 5142 - DNA, 20 bp, Artificial Sequence
  Description of Artificial Sequence: Synthetic oligonucleotide
ccattgcccaggctggagtg

SEQ ID NO: 5143 - DNA, 20 bp, Artificial Sequence
  Description of Artificial Sequence: Synthetic oligonucleotide
cattgcccaggctggagtgc

SEQ ID NO: 5144 - DNA, 20 bp, Artificial Sequence
  Description of Artificial Sequence: Synthetic oligonucleotide
attgcccaggctggagtgca

SEQ ID NO: 5145 - DNA, 20 bp, Artificial Sequence
  Description of Artificial Sequence: Synthetic oligonucleotide
ttgcccaggctggagtgcag

SEQ ID NO: 5146 - DNA, 20 bp, Artificial Sequence
  Description of Artificial Sequence: Synthetic oligonucleotide
tgcccaggctggagtgcagt

SEQ ID NO: 5147 - DNA, 20 bp, Artificial Sequence
  Description of Artificial Sequence: Synthetic oligonucleotide
gcccaggctggagtgcagtg

SEQ ID NO: 5148 - DNA, 20 bp, Artificial Sequence
  Description of Artificial Sequence: Synthetic oligonucleotide
cccaggctggagtgcagtgg

SEQ ID NO: 5149 - DNA, 20 bp, Artificial Sequence
  Description of Artificial Sequence: Synthetic oligonucleotide
ccaggctggagtgcagtggt

SEQ ID NO: 5150 - DNA, 20 bp, Artificial Sequence
  Description of Artificial Sequence: Synthetic oligonucleotide
caggctggagtgcagtggtg

SEQ ID NO: 5151 - DNA, 20 bp, Artificial Sequence
  Description of Artificial Sequence: Synthetic oligonucleotide
aggctggagtgcagtggtgt

SEQ ID NO: 5152 - DNA, 20 bp, Artificial Sequence
  Description of Artificial Sequence: Synthetic oligonucleotide
ggctggagtgcagtggtgtg

SEQ ID NO: 5153 - DNA, 20 bp, Artificial Sequence
  Description of Artificial Sequence: Synthetic oligonucleotide
gctggagtgcagtggtgtgg

SEQ ID NO: 5154 - DNA, 20 bp, Artificial Sequence
  Description of Artificial Sequence: Synthetic oligonucleotide
ctggagtgcagtggtgtggt

SEQ ID NO: 5155 - DNA, 20 bp, Artificial Sequence
  Description of Artificial Sequence: Synthetic oligonucleotide
tggagtgcagtggtgtggtg

SEQ ID NO: 5156 - DNA, 20 bp, Artificial Sequence
  Description of Artificial Sequence: Synthetic oligonucleotide
ggagtgcagtggtgtggtga

SEQ ID NO: 5157 - DNA, 20 bp, Artificial Sequence
  Description of Artificial Sequence: Synthetic oligonucleotide
gagtgcagtggtgtggtgat

SEQ ID NO: 5158 - DNA, 20 bp, Artificial Sequence
  Description of Artificial Sequence: Synthetic oligonucleotide
agtgcagtggtgtggtgatg

SEQ ID NO: 5159 - DNA, 20 bp, Artificial Sequence
  Description of Artificial Sequence: Synthetic oligonucleotide
gtgcagtggtgtggtgatgg

SEQ ID NO: 5160 - DNA, 20 bp, Artificial Sequence
  Description of Artificial Sequence: Synthetic oligonucleotide
tgcagtggtgtggtgatggc

SEQ ID NO: 5161 - DNA, 20 bp, Artificial Sequence
  Description of Artificial Sequence: Synthetic oligonucleotide
gcagtggtgtggtgatggct

SEQ ID NO: 5162 - DNA, 20 bp, Artificial Sequence
  Description of Artificial Sequence: Synthetic oligonucleotide
cagtggtgtggtgatggctc

SEQ ID NO: 5163 - DNA, 20 bp, Artificial Sequence
  Description of Artificial Sequence: Synthetic oligonucleotide
agtggtgtggtgatggctca

SEQ ID NO: 5164 - DNA, 20 bp, Artificial Sequence
  Description of Artificial Sequence: Synthetic oligonucleotide
gtggtgtggtgatggctcaa

SEQ ID NO: 5165 - DNA, 20 bp, Artificial Sequence
  Description of Artificial Sequence: Synthetic oligonucleotide
tggtgtggtgatggctcaat

SEQ ID NO: 5166 - DNA, 20 bp, Artificial Sequence
  Description of Artificial Sequence: Synthetic oligonucleotide
ggtgtggtgatggctcaatg

SEQ ID NO: 5167 - DNA, 20 bp, Artificial Sequence
  Description of Artificial Sequence: Synthetic oligonucleotide
gtgtggtgatggctcaatgc

SEQ ID NO: 5168 - DNA, 20 bp, Artificial Sequence
  Description of Artificial Sequence: Synthetic oligonucleotide
tgtggtgatggctcaatgca

SEQ ID NO: 5169 - DNA, 20 bp, Artificial Sequence
  Description of Artificial Sequence: Synthetic oligonucleotide
gtggtgatggctcaatgcag

SEQ ID NO: 5170 - DNA, 20 bp, Artificial Sequence
  Description of Artificial Sequence: Synthetic oligonucleotide
tggtgatggctcaatgcagc

SEQ ID NO: 5171 - DNA, 20 bp, Artificial Sequence
  Description of Artificial Sequence: Synthetic oligonucleotide
ggtgatggctcaatgcagcg

SEQ ID NO: 5172 - DNA, 20 bp, Artificial Sequence
  Description of Artificial Sequence: Synthetic oligonucleotide
gtgatggctcaatgcagcgt

SEQ ID NO: 5173 - DNA, 20 bp, Artificial Sequence
  Description of Artificial Sequence: Synthetic oligonucleotide
tgatggctcaatgcagcgtc

SEQ ID NO: 5174 - DNA, 20 bp, Artificial Sequence
  Description of Artificial Sequence: Synthetic oligonucleotide
gatggctcaatgcagcgtca

SEQ ID NO: 5175 - DNA, 20 bp, Artificial Sequence
  Description of Artificial Sequence: Synthetic oligonucleotide
atggctcaatgcagcgtcaa

SEQ ID NO: 5176 - DNA, 20 bp, Artificial Sequence
  Description of Artificial Sequence: Synthetic oligonucleotide
tggctcaatgcagcgtcaac

SEQ ID NO: 5177 - DNA, 20 bp, Artificial Sequence
  Description of Artificial Sequence: Synthetic oligonucleotide
ggctcaatgcagcgtcaacc

SEQ ID NO: 5178 - DNA, 20 bp, Artificial Sequence
  Description of Artificial Sequence: Synthetic oligonucleotide
gctcaatgcagcgtcaacct

SEQ ID NO: 5179 - DNA, 20 bp, Artificial Sequence
  Description of Artificial Sequence: Synthetic oligonucleotide
ctcaatgcagcgtcaacctt

SEQ ID NO: 5180 - DNA, 20 bp, Artificial Sequence
  Description of Artificial Sequence: Synthetic oligonucleotide
tcaatgcagcgtcaacctta

SEQ ID NO: 5181 - DNA, 20 bp, Artificial Sequence
  Description of Artificial Sequence: Synthetic oligonucleotide
caatgcagcgtcaaccttac

SEQ ID NO: 5182 - DNA, 20 bp, Artificial Sequence
  Description of Artificial Sequence: Synthetic oligonucleotide
aatgcagcgtcaaccttacg

SEQ ID NO: 5183 - DNA, 20 bp, Artificial Sequence
  Description of Artificial Sequence: Synthetic oligonucleotide
atgcagcgtcaaccttacgg

SEQ ID NO: 5184 - DNA, 20 bp, Artificial Sequence
  Description of Artificial Sequence: Synthetic oligonucleotide
tgcagcgtcaaccttacggg

SEQ ID NO: 5185 - DNA, 20 bp, Artificial Sequence
  Description of Artificial Sequence: Synthetic oligonucleotide
gcagcgtcaaccttacgggc

SEQ ID NO: 5186 - DNA, 20 bp, Artificial Sequence
  Description of Artificial Sequence: Synthetic oligonucleotide
cagcgtcaaccttacgggct

SEQ ID NO: 5187 - DNA, 20 bp, Artificial Sequence
  Description of Artificial Sequence: Synthetic oligonucleotide
agcgtcaaccttacgggctc

SEQ ID NO: 5188 - DNA, 20 bp, Artificial Sequence
  Description of Artificial Sequence: Synthetic oligonucleotide
gcgtcaaccttacgggctca

SEQ ID NO: 5189 - DNA, 20 bp, Artificial Sequence
  Description of Artificial Sequence: Synthetic oligonucleotide
cgtcaaccttacgggctcaa

SEQ ID NO: 5190 - DNA, 20 bp, Artificial Sequence
  Description of Artificial Sequence: Synthetic oligonucleotide
gtcaaccttacgggctcaag

SEQ ID NO: 5191 - DNA, 20 bp, Artificial Sequence
  Description of Artificial Sequence: Synthetic oligonucleotide
tcaaccttacgggctcaagt

SEQ ID NO: 5192 - DNA, 20 bp, Artificial Sequence
  Description of Artificial Sequence: Synthetic oligonucleotide
caaccttacgggctcaagtg

SEQ ID NO: 5193 - DNA, 20 bp, Artificial Sequence
  Description of Artificial Sequence: Synthetic oligonucleotide
aaccttacgggctcaagtga

SEQ ID NO: 5194 - DNA, 20 bp, Artificial Sequence
  Description of Artificial Sequence: Synthetic oligonucleotide
accttacgggctcaagtgat

SEQ ID NO: 5195 - DNA, 20 bp, Artificial Sequence
  Description of Artificial Sequence: Synthetic oligonucleotide
ccttacgggctcaagtgatt

SEQ ID NO: 5196 - DNA, 20 bp, Artificial Sequence
  Description of Artificial Sequence: Synthetic oligonucleotide
cttacgggctcaagtgattc

SEQ ID NO: 5197 - DNA, 20 bp, Artificial Sequence
  Description of Artificial Sequence: Synthetic oligonucleotide
ttacgggctcaagtgattct

SEQ ID NO: 5198 - DNA, 20 bp, Artificial Sequence
  Description of Artificial Sequence: Synthetic oligonucleotide
tacgggctcaagtgattctt

SEQ ID NO: 5199 - DNA, 20 bp, Artificial Sequence
  Description of Artificial Sequence: Synthetic oligonucleotide
acgggctcaagtgattcttg

SEQ ID NO: 5200 - DNA, 20 bp, Artificial Sequence
  Description of Artificial Sequence: Synthetic oligonucleotide
cgggctcaagtgattcttgt

SEQ ID NO: 5201 - DNA, 20 bp, Artificial Sequence
  Description of Artificial Sequence: Synthetic oligonucleotide
gggctcaagtgattcttgta

SEQ ID NO: 5202 - DNA, 20 bp, Artificial Sequence
  Description of Artificial Sequence: Synthetic oligonucleotide
ggctcaagtgattcttgtac

SEQ ID NO: 5203 - DNA, 20 bp, Artificial Sequence
  Description of Artificial Sequence: Synthetic oligonucleotide
gctcaagtgattcttgtacc

SEQ ID NO: 5204 - DNA, 20 bp, Artificial Sequence
  Description of Artificial Sequence: Synthetic oligonucleotide
ctcaagtgattcttgtacct

SEQ ID NO: 5205 - DNA, 20 bp, Artificial Sequence
  Description of Artificial Sequence: Synthetic oligonucleotide
tcaagtgattcttgtacctg

SEQ ID NO: 5206 - DNA, 20 bp, Artificial Sequence
  Description of Artificial Sequence: Synthetic oligonucleotide
caagtgattcttgtacctgg

SEQ ID NO: 5207 - DNA, 20 bp, Artificial Sequence
  Description of Artificial Sequence: Synthetic oligonucleotide
aagtgattcttgtacctggg

SEQ ID NO: 5208 - DNA, 20 bp, Artificial Sequence
  Description of Artificial Sequence: Synthetic oligonucleotide
agtgattcttgtacctgggc

SEQ ID NO: 5209 - DNA, 20 bp, Artificial Sequence
  Description of Artificial Sequence: Synthetic oligonucleotide
gtgattcttgtacctgggcc

SEQ ID NO: 5210 - DNA, 20 bp, Artificial Sequence
  Description of Artificial Sequence: Synthetic oligonucleotide
tgattcttgtacctgggcct

SEQ ID NO: 5211 - DNA, 20 bp, Artificial Sequence
  Description of Artificial Sequence: Synthetic oligonucleotide
gattcttgtacctgggcctc

SEQ ID NO: 5212 - DNA, 20 bp, Artificial Sequence
  Description of Artificial Sequence: Synthetic oligonucleotide
attcttgtacctgggcctcc

SEQ ID NO: 5213 - DNA, 20 bp, Artificial Sequence
  Description of Artificial Sequence: Synthetic oligonucleotide
ttcttgtacctgggcctccc

SEQ ID NO: 5214 - DNA, 20 bp, Artificial Sequence
  Description of Artificial Sequence: Synthetic oligonucleotide
tcttgtacctgggcctccca

SEQ ID NO: 5215 - DNA, 20 bp, Artificial Sequence
  Description of Artificial Sequence: Synthetic oligonucleotide
cttgtacctgggcctcccaa

SEQ ID NO: 5216 - DNA, 20 bp, Artificial Sequence
  Description of Artificial Sequence: Synthetic oligonucleotide
ttgtacctgggcctcccaag

SEQ ID NO: 5217 - DNA, 20 bp, Artificial Sequence
  Description of Artificial Sequence: Synthetic oligonucleotide
tgtacctgggcctcccaagt

SEQ ID NO: 5218 - DNA, 20 bp, Artificial Sequence
  Description of Artificial Sequence: Synthetic oligonucleotide
gtacctgggcctcccaagta

SEQ ID NO: 5219 - DNA, 20 bp, Artificial Sequence
  Description of Artificial Sequence: Synthetic oligonucleotide
tacctgggcctcccaagtag

SEQ ID NO: 5220 - DNA, 20 bp, Artificial Sequence
  Description of Artificial Sequence: Synthetic oligonucleotide
acctgggcctcccaagtagc

SEQ ID NO: 5221 - DNA, 20 bp, Artificial Sequence
  Description of Artificial Sequence: Synthetic oligonucleotide
cctgggcctcccaagtagct

SEQ ID NO: 5222 - DNA, 20 bp, Artificial Sequence
  Description of Artificial Sequence: Synthetic oligonucleotide
ctgggcctcccaagtagctg

SEQ ID NO: 5223 - DNA, 20 bp, Artificial Sequence
  Description of Artificial Sequence: Synthetic oligonucleotide
tgggcctcccaagtagctgg

SEQ ID NO: 5224 - DNA, 20 bp, Artificial Sequence
  Description of Artificial Sequence: Synthetic oligonucleotide
gggcctcccaagtagctggg

SEQ ID NO: 5225 - DNA, 20 bp, Artificial Sequence
  Description of Artificial Sequence: Synthetic oligonucleotide
ggcctcccaagtagctggga

SEQ ID NO: 5226 - DNA, 20 bp, Artificial Sequence
  Description of Artificial Sequence: Synthetic oligonucleotide
gcctcccaagtagctgggac

SEQ ID NO: 5227 - DNA, 20 bp, Artificial Sequence
  Description of Artificial Sequence: Synthetic oligonucleotide
cctcccaagtagctgggacc

SEQ ID NO: 5228 - DNA, 20 bp, Artificial Sequence
  Description of Artificial Sequence: Synthetic oligonucleotide
ctcccaagtagctgggacca

SEQ ID NO: 5229 - DNA, 20 bp, Artificial Sequence
  Description of Artificial Sequence: Synthetic oligonucleotide
tcccaagtagctgggaccac

SEQ ID NO: 5230 - DNA, 20 bp, Artificial Sequence
  Description of Artificial Sequence: Synthetic oligonucleotide
cccaagtagctgggaccaca

SEQ ID NO: 5231 - DNA, 20 bp, Artificial Sequence
  Description of Artificial Sequence: Synthetic oligonucleotide
ccaagtagctgggaccacag

SEQ ID NO: 5232 - DNA, 20 bp, Artificial Sequence
  Description of Artificial Sequence: Synthetic oligonucleotide
caagtagctgggaccacagg

SEQ ID NO: 5233 - DNA, 20 bp, Artificial Sequence
  Description of Artificial Sequence: Synthetic oligonucleotide
aagtagctgggaccacaggt

SEQ ID NO: 5234 - DNA, 20 bp, Artificial Sequence
  Description of Artificial Sequence: Synthetic oligonucleotide
agtagctgggaccacaggtg

SEQ ID NO: 5235 - DNA, 20 bp, Artificial Sequence
  Description of Artificial Sequence: Synthetic oligonucleotide
gtagctgggaccacaggtgt

SEQ ID NO: 5236 - DNA, 20 bp, Artificial Sequence
  Description of Artificial Sequence: Synthetic oligonucleotide
tagctgggaccacaggtgtg

SEQ ID NO: 5237 - DNA, 20 bp, Artificial Sequence
  Description of Artificial Sequence: Synthetic oligonucleotide
agctgggaccacaggtgtga

SEQ ID NO: 5238 - DNA, 20 bp, Artificial Sequence
  Description of Artificial Sequence: Synthetic oligonucleotide
gctgggaccacaggtgtgag

SEQ ID NO: 5239 - DNA, 20 bp, Artificial Sequence
  Description of Artificial Sequence: Synthetic oligonucleotide
ctgggaccacaggtgtgagc

SEQ ID NO: 5240 - DNA, 20 bp, Artificial Sequence
  Description of Artificial Sequence: Synthetic oligonucleotide
tgggaccacaggtgtgagcc

SEQ ID NO: 5241 - DNA, 20 bp, Artificial Sequence
  Description of Artificial Sequence: Synthetic oligonucleotide
gggaccacaggtgtgagcca

SEQ ID NO: 5242 - DNA, 20 bp, Artificial Sequence
  Description of Artificial Sequence: Synthetic oligonucleotide
ggaccacaggtgtgagccac

SEQ ID NO: 5243 - DNA, 20 bp, Artificial Sequence
  Description of Artificial Sequence: Synthetic oligonucleotide
gaccacaggtgtgagccacc

SEQ ID NO: 5244 - DNA, 20 bp, Artificial Sequence
  Description of Artificial Sequence: Synthetic oligonucleotide
accacaggtgtgagccacca

SEQ ID NO: 5245 - DNA, 20 bp, Artificial Sequence
  Description of Artificial Sequence: Synthetic oligonucleotide
ccacaggtgtgagccaccat

SEQ ID NO: 5246 - DNA, 20 bp, Artificial Sequence
  Description of Artificial Sequence: Synthetic oligonucleotide
cacaggtgtgagccaccatg

SEQ ID NO: 5247 - DNA, 20 bp, Artificial Sequence
  Description of Artificial Sequence: Synthetic oligonucleotide
acaggtgtgagccaccatgc

SEQ ID NO: 5248 - DNA, 20 bp, Artificial Sequence
  Description of Artificial Sequence: Synthetic oligonucleotide
caggtgtgagccaccatgcc

SEQ ID NO: 5249 - DNA, 20 bp, Artificial Sequence
  Description of Artificial Sequence: Synthetic oligonucleotide
aggtgtgagccaccatgcct

SEQ ID NO: 5250 - DNA, 20 bp, Artificial Sequence
  Description of Artificial Sequence: Synthetic oligonucleotide
ggtgtgagccaccatgcctg

SEQ ID NO: 5251 - DNA, 20 bp, Artificial Sequence
  Description of Artificial Sequence: Synthetic oligonucleotide
gtgtgagccaccatgcctgc

SEQ ID NO: 5252 - DNA, 20 bp, Artificial Sequence
  Description of Artificial Sequence: Synthetic oligonucleotide
tgtgagccaccatgcctgca

SEQ ID NO: 5253 - DNA, 20 bp, Artificial Sequence
  Description of Artificial Sequence: Synthetic oligonucleotide
gtgagccaccatgcctgcat

SEQ ID NO: 5254 - DNA, 20 bp, Artificial Sequence
  Description of Artificial Sequence: Synthetic oligonucleotide
tgagccaccatgcctgcatt

SEQ ID NO: 5255 - DNA, 20 bp, Artificial Sequence
  Description of Artificial Sequence: Synthetic oligonucleotide
gagccaccatgcctgcattt

SEQ ID NO: 5256 - DNA, 20 bp, Artificial Sequence
  Description of Artificial Sequence: Synthetic oligonucleotide
agccaccatgcctgcatttt

SEQ ID NO: 5257 - DNA, 20 bp, Artificial Sequence
  Description of Artificial Sequence: Synthetic oligonucleotide
gccaccatgcctgcattttt

SEQ ID NO: 5258 - DNA, 20 bp, Artificial Sequence
  Description of Artificial Sequence: Synthetic oligonucleotide
ccaccatgcctgcatttttt

SEQ ID NO: 5259 - DNA, 20 bp, Artificial Sequence
  Description of Artificial Sequence: Synthetic oligonucleotide
caccatgcctgcattttttc

SEQ ID NO: 5260 - DNA, 20 bp, Artificial Sequence
  Description of Artificial Sequence: Synthetic oligonucleotide
accatgcctgcattttttct

SEQ ID NO: 5261 - DNA, 20 bp, Artificial Sequence
  Description of Artificial Sequence: Synthetic oligonucleotide
ccatgcctgcattttttctt

SEQ ID NO: 5262 - DNA, 20 bp, Artificial Sequence
  Description of Artificial Sequence: Synthetic oligonucleotide
catgcctgcattttttcttt

SEQ ID NO: 5263 - DNA, 20 bp, Artificial Sequence
  Description of Artificial Sequence: Synthetic oligonucleotide
atgcctgcattttttctttt

SEQ ID NO: 5264 - DNA, 20 bp, Artificial Sequence
  Description of Artificial Sequence: Synthetic oligonucleotide
tgcctgcattttttcttttt

SEQ ID NO: 5265 - DNA, 20 bp, Artificial Sequence
  Description of Artificial Sequence: Synthetic oligonucleotide
gcctgcattttttctttttc

SEQ ID NO: 5266 - DNA, 20 bp, Artificial Sequence
  Description of Artificial Sequence: Synthetic oligonucleotide
cctgcattttttctttttct

SEQ ID NO: 5267 - DNA, 20 bp, Artificial Sequence
  Description of Artificial Sequence: Synthetic oligonucleotide
ctgcattttttctttttctt

SEQ ID NO: 5268 - DNA, 20 bp, Artificial Sequence
  Description of Artificial Sequence: Synthetic oligonucleotide
tgcattttttctttttcttt

SEQ ID NO: 5269 - DNA, 20 bp, Artificial Sequence
  Description of Artificial Sequence: Synthetic oligonucleotide
gcattttttctttttctttt

SEQ ID NO: 5270 - DNA, 20 bp, Artificial Sequence
  Description of Artificial Sequence: Synthetic oligonucleotide
cattttttctttttcttttg

SEQ ID NO: 5271 - DNA, 20 bp, Artificial Sequence
  Description of Artificial Sequence: Synthetic oligonucleotide
attttttctttttcttttga

SEQ ID NO: 5272 - DNA, 20 bp, Artificial Sequence
  Description of Artificial Sequence: Synthetic oligonucleotide
ttttttctttttcttttgag

SEQ ID NO: 5273 - DNA, 20 bp, Artificial Sequence
  Description of Artificial Sequence: Synthetic oligonucleotide
tttttctttttcttttgagg

SEQ ID NO: 5274 - DNA, 20 bp, Artificial Sequence
  Description of Artificial Sequence: Synthetic oligonucleotide
ttttctttttcttttgaggc

SEQ ID NO: 5275 - DNA, 20 bp, Artificial Sequence
  Description of Artificial Sequence: Synthetic oligonucleotide
tttctttttcttttgaggca

SEQ ID NO: 5276 - DNA, 20 bp, Artificial Sequence
  Description of Artificial Sequence: Synthetic oligonucleotide
ttctttttcttttgaggcag

SEQ ID NO: 5277 - DNA, 20 bp, Artificial Sequence
  Description of Artificial Sequence: Synthetic oligonucleotide
tctttttcttttgaggcagg

SEQ ID NO: 5278 - DNA, 20 bp, Artificial Sequence
  Description of Artificial Sequence: Synthetic oligonucleotide
ctttttcttttgaggcaggg

SEQ ID NO: 5279 - DNA, 20 bp, Artificial Sequence
  Description of Artificial Sequence: Synthetic oligonucleotide
tttttcttttgaggcagggg

SEQ ID NO: 5280 - DNA, 20 bp, Artificial Sequence
  Description of Artificial Sequence: Synthetic oligonucleotide
ttttcttttgaggcaggggt

SEQ ID NO: 5281 - DNA, 20 bp, Artificial Sequence
  Description of Artificial Sequence: Synthetic oligonucleotide
tttcttttgaggcaggggtc

SEQ ID NO: 5282 - DNA, 20 bp, Artificial Sequence
  Description of Artificial Sequence: Synthetic oligonucleotide
ttcttttgaggcaggggtct

SEQ ID NO: 5283 - DNA, 20 bp, Artificial Sequence
  Description of Artificial Sequence: Synthetic oligonucleotide
tcttttgaggcaggggtctc

SEQ ID NO: 5284 - DNA, 20 bp, Artificial Sequence
  Description of Artificial Sequence: Synthetic oligonucleotide
cttttgaggcaggggtctca

SEQ ID NO: 5285 - DNA, 20 bp, Artificial Sequence
  Description of Artificial Sequence: Synthetic oligonucleotide
ttttgaggcaggggtctcac

SEQ ID NO: 5286 - DNA, 20 bp, Artificial Sequence
  Description of Artificial Sequence: Synthetic oligonucleotide
tttgaggcaggggtctcact

SEQ ID NO: 5287 - DNA, 20 bp, Artificial Sequence
  Description of Artificial Sequence: Synthetic oligonucleotide
ttgaggcaggggtctcactc

SEQ ID NO: 5288 - DNA, 20 bp, Artificial Sequence
  Description of Artificial Sequence: Synthetic oligonucleotide
tgaggcaggggtctcactct

SEQ ID NO: 5289 - DNA, 20 bp, Artificial Sequence
  Description of Artificial Sequence: Synthetic oligonucleotide
gaggcaggggtctcactctg

SEQ ID NO: 5290 - DNA, 20 bp, Artificial Sequence
  Description of Artificial Sequence: Synthetic oligonucleotide
aggcaggggtctcactctgt

SEQ ID NO: 5291 - DNA, 20 bp, Artificial Sequence
  Description of Artificial Sequence: Synthetic oligonucleotide
ggcaggggtctcactctgtc

SEQ ID NO: 5292 - DNA, 20 bp, Artificial Sequence
  Description of Artificial Sequence: Synthetic oligonucleotide
gcaggggtctcactctgtca

SEQ ID NO: 5293 - DNA, 20 bp, Artificial Sequence
  Description of Artificial Sequence: Synthetic oligonucleotide
caggggtctcactctgtcac

SEQ ID NO: 5294 - DNA, 20 bp, Artificial Sequence
  Description of Artificial Sequence: Synthetic oligonucleotide
aggggtctcactctgtcacc

SEQ ID NO: 5295 - DNA, 20 bp, Artificial Sequence
  Description of Artificial Sequence: Synthetic oligonucleotide
ggggtctcactctgtcaccc

SEQ ID NO: 5296 - DNA, 20 bp, Artificial Sequence
  Description of Artificial Sequence: Synthetic oligonucleotide
gggtctcactctgtcaccca

SEQ ID NO: 5297 - DNA, 20 bp, Artificial Sequence
  Description of Artificial Sequence: Synthetic oligonucleotide
ggtctcactctgtcacccag

SEQ ID NO: 5298 - DNA, 20 bp, Artificial Sequence
  Description of Artificial Sequence: Synthetic oligonucleotide
gtctcactctgtcacccagg

SEQ ID NO: 5299 - DNA, 20 bp, Artificial Sequence
  Description of Artificial Sequence: Synthetic oligonucleotide
tctcactctgtcacccaggc

SEQ ID NO: 5300 - DNA, 20 bp, Artificial Sequence
  Description of Artificial Sequence: Synthetic oligonucleotide
ctcactctgtcacccaggct

SEQ ID NO: 5301 - DNA, 20 bp, Artificial Sequence
  Description of Artificial Sequence: Synthetic oligonucleotide
tcactctgtcacccaggctt

SEQ ID NO: 5302 - DNA, 20 bp, Artificial Sequence
  Description of Artificial Sequence: Synthetic oligonucleotide
cactctgtcacccaggcttg

SEQ ID NO: 5303 - DNA, 20 bp, Artificial Sequence
  Description of Artificial Sequence: Synthetic oligonucleotide
actctgtcacccaggcttga

SEQ ID NO: 5304 - DNA, 20 bp, Artificial Sequence
  Description of Artificial Sequence: Synthetic oligonucleotide
ctctgtcacccaggcttgag

SEQ ID NO: 5305 - DNA, 20 bp, Artificial Sequence
  Description of Artificial Sequence: Synthetic oligonucleotide
tctgtcacccaggcttgagt

SEQ ID NO: 5306 - DNA, 20 bp, Artificial Sequence
  Description of Artificial Sequence: Synthetic oligonucleotide
ctgtcacccaggcttgagtg

SEQ ID NO: 5307 - DNA, 20 bp, Artificial Sequence
  Description of Artificial Sequence: Synthetic oligonucleotide
tgtcacccaggcttgagtgc

SEQ ID NO: 5308 - DNA, 20 bp, Artificial Sequence
  Description of Artificial Sequence: Synthetic oligonucleotide
gtcacccaggcttgagtgca

SEQ ID NO: 5309 - DNA, 20 bp, Artificial Sequence
  Description of Artificial Sequence: Synthetic oligonucleotide
tcacccaggcttgagtgcag

SEQ ID NO: 5310 - DNA, 20 bp, Artificial Sequence
  Description of Artificial Sequence: Synthetic oligonucleotide
cacccaggcttgagtgcagt

SEQ ID NO: 5311 - DNA, 20 bp, Artificial Sequence
  Description of Artificial Sequence: Synthetic oligonucleotide
acccaggcttgagtgcagtg

SEQ ID NO: 5312 - DNA, 20 bp, Artificial Sequence
  Description of Artificial Sequence: Synthetic oligonucleotide
cccaggcttgagtgcagtgg

SEQ ID NO: 5313 - DNA, 20 bp, Artificial Sequence
  Description of Artificial Sequence: Synthetic oligonucleotide
ccaggcttgagtgcagtggc

SEQ ID NO: 5314 - DNA, 20 bp, Artificial Sequence
  Description of Artificial Sequence: Synthetic oligonucleotide
caggcttgagtgcagtggcg

SEQ ID NO: 5315 - DNA, 20 bp, Artificial Sequence
  Description of Artificial Sequence: Synthetic oligonucleotide
aggcttgagtgcagtggcgc

SEQ ID NO: 5316 - DNA, 20 bp, Artificial Sequence
  Description of Artificial Sequence: Synthetic oligonucleotide
ggcttgagtgcagtggcgca

SEQ ID NO: 5317 - DNA, 20 bp, Artificial Sequence
  Description of Artificial Sequence: Synthetic oligonucleotide
gcttgagtgcagtggcgcag

SEQ ID NO: 5318 - DNA, 20 bp, Artificial Sequence
  Description of Artificial Sequence: Synthetic oligonucleotide
cttgagtgcagtggcgcagt

SEQ ID NO: 5319 - DNA, 20 bp, Artificial Sequence
  Description of Artificial Sequence: Synthetic oligonucleotide
ttgagtgcagtggcgcagtc

SEQ ID NO: 5320 - DNA, 20 bp, Artificial Sequence
  Description of Artificial Sequence: Synthetic oligonucleotide
tgagtgcagtggcgcagtct

SEQ ID NO: 5321 - DNA, 20 bp, Artificial Sequence
  Description of Artificial Sequence: Synthetic oligonucleotide
gagtgcagtggcgcagtctc

SEQ ID NO: 5322 - DNA, 20 bp, Artificial Sequence
  Description of Artificial Sequence: Synthetic oligonucleotide
agtgcagtggcgcagtctca

SEQ ID NO: 5323 - DNA, 20 bp, Artificial Sequence
  Description of Artificial Sequence: Synthetic oligonucleotide
gtgcagtggcgcagtctcag

SEQ ID NO: 5324 - DNA, 20 bp, Artificial Sequence
  Description of Artificial Sequence: Synthetic oligonucleotide
tgcagtggcgcagtctcagc

SEQ ID NO: 5325 - DNA, 20 bp, Artificial Sequence
  Description of Artificial Sequence: Synthetic oligonucleotide
gcagtggcgcagtctcagct

SEQ ID NO: 5326 - DNA, 20 bp, Artificial Sequence
  Description of Artificial Sequence: Synthetic oligonucleotide
cagtggcgcagtctcagctc

SEQ ID NO: 5327 - DNA, 20 bp, Artificial Sequence
  Description of Artificial Sequence: Synthetic oligonucleotide
agtggcgcagtctcagctca

SEQ ID NO: 5328 - DNA, 20 bp, Artificial Sequence
  Description of Artificial Sequence: Synthetic oligonucleotide
gtggcgcagtctcagctcac

SEQ ID NO: 5329 - DNA, 20 bp, Artificial Sequence
  Description of Artificial Sequence: Synthetic oligonucleotide
tggcgcagtctcagctcact

SEQ ID NO: 5330 - DNA, 20 bp, Artificial Sequence
  Description of Artificial Sequence: Synthetic oligonucleotide
ggcgcagtctcagctcactg

SEQ ID NO: 5331 - DNA, 20 bp, Artificial Sequence
  Description of Artificial Sequence: Synthetic oligonucleotide
gcgcagtctcagctcactgc

SEQ ID NO: 5332 - DNA, 20 bp, Artificial Sequence
  Description of Artificial Sequence: Synthetic oligonucleotide
cgcagtctcagctcactgca

SEQ ID NO: 5333 - DNA, 20 bp, Artificial Sequence
  Description of Artificial Sequence: Synthetic oligonucleotide
gcagtctcagctcactgcag

SEQ ID NO: 5334 - DNA, 20 bp, Artificial Sequence
  Description of Artificial Sequence: Synthetic oligonucleotide
cagtctcagctcactgcagc

SEQ ID NO: 5335 - DNA, 20 bp, Artificial Sequence
  Description of Artificial Sequence: Synthetic oligonucleotide
agtctcagctcactgcagcc

SEQ ID NO: 5336 - DNA, 20 bp, Artificial Sequence
  Description of Artificial Sequence: Synthetic oligonucleotide
gtctcagctcactgcagcct

SEQ ID NO: 5337 - DNA, 20 bp, Artificial Sequence
  Description of Artificial Sequence: Synthetic oligonucleotide
tctcagctcactgcagcctt

SEQ ID NO: 5338 - DNA, 20 bp, Artificial Sequence
  Description of Artificial Sequence: Synthetic oligonucleotide
ctcagctcactgcagcctta

SEQ ID NO: 5339 - DNA, 20 bp, Artificial Sequence
  Description of Artificial Sequence: Synthetic oligonucleotide
tcagctcactgcagccttat

SEQ ID NO: 5340 - DNA, 20 bp, Artificial Sequence
  Description of Artificial Sequence: Synthetic oligonucleotide
cagctcactgcagccttatc

SEQ ID NO: 5341 - DNA, 20 bp, Artificial Sequence
  Description of Artificial Sequence: Synthetic oligonucleotide
agctcactgcagccttatct

SEQ ID NO: 5342 - DNA, 20 bp, Artificial Sequence
  Description of Artificial Sequence: Synthetic oligonucleotide
gctcactgcagccttatctc

SEQ ID NO: 5343 - DNA, 20 bp, Artificial Sequence
  Description of Artificial Sequence: Synthetic oligonucleotide
ctcactgcagccttatctcc

SEQ ID NO: 5344 - DNA, 20 bp, Artificial Sequence
  Description of Artificial Sequence: Synthetic oligonucleotide
tcactgcagccttatctcct

SEQ ID NO: 5345 - DNA, 20 bp, Artificial Sequence
  Description of Artificial Sequence: Synthetic oligonucleotide
cactgcagccttatctccta

SEQ ID NO: 5346 - DNA, 20 bp, Artificial Sequence
  Description of Artificial Sequence: Synthetic oligonucleotide
actgcagccttatctcctag

SEQ ID NO: 5347 - DNA, 20 bp, Artificial Sequence
  Description of Artificial Sequence: Synthetic oligonucleotide
ctgcagccttatctcctagg

SEQ ID NO: 5348 - DNA, 20 bp, Artificial Sequence
  Description of Artificial Sequence: Synthetic oligonucleotide
tgcagccttatctcctaggc

SEQ ID NO: 5349 - DNA, 20 bp, Artificial Sequence
  Description of Artificial Sequence: Synthetic oligonucleotide
gcagccttatctcctaggct

SEQ ID NO: 5350 - DNA, 20 bp, Artificial Sequence
  Description of Artificial Sequence: Synthetic oligonucleotide
cagccttatctcctaggctc

SEQ ID NO: 5351 - DNA, 20 bp, Artificial Sequence
  Description of Artificial Sequence: Synthetic oligonucleotide
agccttatctcctaggctca

SEQ ID NO: 5352 - DNA, 20 bp, Artificial Sequence
  Description of Artificial Sequence: Synthetic oligonucleotide
gccttatctcctaggctcaa

SEQ ID NO: 5353 - DNA, 20 bp, Artificial Sequence
  Description of Artificial Sequence: Synthetic oligonucleotide
ccttatctcctaggctcaag

SEQ ID NO: 5354 - DNA, 20 bp, Artificial Sequence
  Description of Artificial Sequence: Synthetic oligonucleotide
cttatctcctaggctcaaga

SEQ ID NO: 5355 - DNA, 20 bp, Artificial Sequence
  Description of Artificial Sequence: Synthetic oligonucleotide
ttatctcctaggctcaagag

SEQ ID NO: 5356 - DNA, 20 bp, Artificial Sequence
  Description of Artificial Sequence: Synthetic oligonucleotide
tatctcctaggctcaagaga

SEQ ID NO: 5357 - DNA, 20 bp, Artificial Sequence
  Description of Artificial Sequence: Synthetic oligonucleotide
atctcctaggctcaagagat

SEQ ID NO: 5358 - DNA, 20 bp, Artificial Sequence
  Description of Artificial Sequence: Synthetic oligonucleotide
tctcctaggctcaagagatc

SEQ ID NO: 5359 - DNA, 20 bp, Artificial Sequence
  Description of Artificial Sequence: Synthetic oligonucleotide
ctcctaggctcaagagatcc

SEQ ID NO: 5360 - DNA, 20 bp, Artificial Sequence
  Description of Artificial Sequence: Synthetic oligonucleotide
tcctaggctcaagagatcct

SEQ ID NO: 5361 - DNA, 20 bp, Artificial Sequence
  Description of Artificial Sequence: Synthetic oligonucleotide
cctaggctcaagagatcctc

SEQ ID NO: 5362 - DNA, 20 bp, Artificial Sequence
  Description of Artificial Sequence: Synthetic oligonucleotide
ctaggctcaagagatcctcc

SEQ ID NO: 5363 - DNA, 20 bp, Artificial Sequence
  Description of Artificial Sequence: Synthetic oligonucleotide
taggctcaagagatcctccc

SEQ ID NO: 5364 - DNA, 20 bp, Artificial Sequence
  Description of Artificial Sequence: Synthetic oligonucleotide
aggctcaagagatcctccca

SEQ ID NO: 5365 - DNA, 20 bp, Artificial Sequence
  Description of Artificial Sequence: Synthetic oligonucleotide
ggctcaagagatcctcccaa

SEQ ID NO: 5366 - DNA, 20 bp, Artificial Sequence
  Description of Artificial Sequence: Synthetic oligonucleotide
gctcaagagatcctcccaac

SEQ ID NO: 5367 - DNA, 20 bp, Artificial Sequence
  Description of Artificial Sequence: Synthetic oligonucleotide
ctcaagagatcctcccaact

SEQ ID NO: 5368 - DNA, 20 bp, Artificial Sequence
  Description of Artificial Sequence: Synthetic oligonucleotide
tcaagagatcctcccaactc

SEQ ID NO: 5369 - DNA, 20 bp, Artificial Sequence
  Description of Artificial Sequence: Synthetic oligonucleotide
caagagatcctcccaactca

SEQ ID NO: 5370 - DNA, 20 bp, Artificial Sequence
  Description of Artificial Sequence: Synthetic oligonucleotide
aagagatcctcccaactcag

SEQ ID NO: 5371 - DNA, 20 bp, Artificial Sequence
  Description of Artificial Sequence: Synthetic oligonucleotide
agagatcctcccaactcagc

SEQ ID NO: 5372 - DNA, 20 bp, Artificial Sequence
  Description of Artificial Sequence: Synthetic oligonucleotide
gagatcctcccaactcagcc

SEQ ID NO: 5373 - DNA, 20 bp, Artificial Sequence
  Description of Artificial Sequence: Synthetic oligonucleotide
agatcctcccaactcagcct

SEQ ID NO: 5374 - DNA, 20 bp, Artificial Sequence
  Description of Artificial Sequence: Synthetic oligonucleotide
gatcctcccaactcagcctc

SEQ ID NO: 5375 - DNA, 20 bp, Artificial Sequence
  Description of Artificial Sequence: Synthetic oligonucleotide
atcctcccaactcagcctcc

SEQ ID NO: 5376 - DNA, 20 bp, Artificial Sequence
  Description of Artificial Sequence: Synthetic oligonucleotide
tcctcccaactcagcctccc

SEQ ID NO: 5377 - DNA, 20 bp, Artificial Sequence
  Description of Artificial Sequence: Synthetic oligonucleotide
cctcccaactcagcctccca

SEQ ID NO: 5378 - DNA, 20 bp, Artificial Sequence
  Description of Artificial Sequence: Synthetic oligonucleotide
ctcccaactcagcctcccaa

SEQ ID NO: 5379 - DNA, 20 bp, Artificial Sequence
  Description of Artificial Sequence: Synthetic oligonucleotide
tcccaactcagcctcccaag

SEQ ID NO: 5380 - DNA, 20 bp, Artificial Sequence
  Description of Artificial Sequence: Synthetic oligonucleotide
cccaactcagcctcccaagt

SEQ ID NO: 5381 - DNA, 20 bp, Artificial Sequence
  Description of Artificial Sequence: Synthetic oligonucleotide
ccaactcagcctcccaagta

SEQ ID NO: 5382 - DNA, 20 bp, Artificial Sequence
  Description of Artificial Sequence: Synthetic oligonucleotide
caactcagcctcccaagtag

SEQ ID NO: 5383 - DNA, 20 bp, Artificial Sequence
  Description of Artificial Sequence: Synthetic oligonucleotide
aactcagcctcccaagtaga

SEQ ID NO: 5384 - DNA, 20 bp, Artificial Sequence
  Description of Artificial Sequence: Synthetic oligonucleotide
actcagcctcccaagtagat

SEQ ID NO: 5385 - DNA, 20 bp, Artificial Sequence
  Description of Artificial Sequence: Synthetic oligonucleotide
ctcagcctcccaagtagatg

SEQ ID NO: 5386 - DNA, 20 bp, Artificial Sequence
  Description of Artificial Sequence: Synthetic oligonucleotide
tcagcctcccaagtagatgg

SEQ ID NO: 5387 - DNA, 20 bp, Artificial Sequence
  Description of Artificial Sequence: Synthetic oligonucleotide
cagcctcccaagtagatggg

SEQ ID NO: 5388 - DNA, 20 bp, Artificial Sequence
  Description of Artificial Sequence: Synthetic oligonucleotide
agcctcccaagtagatggga

SEQ ID NO: 5389 - DNA, 20 bp, Artificial Sequence
  Description of Artificial Sequence: Synthetic oligonucleotide
gcctcccaagtagatgggaa

SEQ ID NO: 5390 - DNA, 20 bp, Artificial Sequence
  Description of Artificial Sequence: Synthetic oligonucleotide
cctcccaagtagatgggaac

SEQ ID NO: 5391 - DNA, 20 bp, Artificial Sequence
  Description of Artificial Sequence: Synthetic oligonucleotide
ctcccaagtagatgggaaca

SEQ ID NO: 5392 - DNA, 20 bp, Artificial Sequence
  Description of Artificial Sequence: Synthetic oligonucleotide
tcccaagtagatgggaacac

SEQ ID NO: 5393 - DNA, 20 bp, Artificial Sequence
  Description of Artificial Sequence: Synthetic oligonucleotide
cccaagtagatgggaacaca

SEQ ID NO: 5394 - DNA, 20 bp, Artificial Sequence
  Description of Artificial Sequence: Synthetic oligonucleotide
ccaagtagatgggaacacag

SEQ ID NO: 5395 - DNA, 20 bp, Artificial Sequence
  Description of Artificial Sequence: Synthetic oligonucleotide
caagtagatgggaacacagg

SEQ ID NO: 5396 - DNA, 20 bp, Artificial Sequence
  Description of Artificial Sequence: Synthetic oligonucleotide
aagtagatgggaacacaggc

SEQ ID NO: 5397 - DNA, 20 bp, Artificial Sequence
  Description of Artificial Sequence: Synthetic oligonucleotide
agtagatgggaacacaggca

SEQ ID NO: 5398 - DNA, 20 bp, Artificial Sequence
  Description of Artificial Sequence: Synthetic oligonucleotide
gtagatgggaacacaggcag

SEQ ID NO: 5399 - DNA, 20 bp, Artificial Sequence
  Description of Artificial Sequence: Synthetic oligonucleotide
tagatgggaacacaggcagg

SEQ ID NO: 5400 - DNA, 20 bp, Artificial Sequence
  Description of Artificial Sequence: Synthetic oligonucleotide
agatgggaacacaggcaggc

SEQ ID NO: 5401 - DNA, 20 bp, Artificial Sequence
  Description of Artificial Sequence: Synthetic oligonucleotide
gatgggaacacaggcaggca

SEQ ID NO: 5402 - DNA, 20 bp, Artificial Sequence
  Description of Artificial Sequence: Synthetic oligonucleotide
atgggaacacaggcaggcac

SEQ ID NO: 5403 - DNA, 20 bp, Artificial Sequence
  Description of Artificial Sequence: Synthetic oligonucleotide
tgggaacacaggcaggcacc

SEQ ID NO: 5404 - DNA, 20 bp, Artificial Sequence
  Description of Artificial Sequence: Synthetic oligonucleotide
gggaacacaggcaggcacca

SEQ ID NO: 5405 - DNA, 20 bp, Artificial Sequence
  Description of Artificial Sequence: Synthetic oligonucleotide
ggaacacaggcaggcaccac

SEQ ID NO: 5406 - DNA, 20 bp, Artificial Sequence
  Description of Artificial Sequence: Synthetic oligonucleotide
gaacacaggcaggcaccacc

SEQ ID NO: 5407 - DNA, 20 bp, Artificial Sequence
  Description of Artificial Sequence: Synthetic oligonucleotide
aacacaggcaggcaccacca

SEQ ID NO: 5408 - DNA, 20 bp, Artificial Sequence
  Description of Artificial Sequence: Synthetic oligonucleotide
acacaggcaggcaccaccat

SEQ ID NO: 5409 - DNA, 20 bp, Artificial Sequence
  Description of Artificial Sequence: Synthetic oligonucleotide
cacaggcaggcaccaccatg

SEQ ID NO: 5410 - DNA, 20 bp, Artificial Sequence
  Description of Artificial Sequence: Synthetic oligonucleotide
acaggcaggcaccaccatgc

SEQ ID NO: 5411 - DNA, 20 bp, Artificial Sequence
  Description of Artificial Sequence: Synthetic oligonucleotide
caggcaggcaccaccatgcc

SEQ ID NO: 5412 - DNA, 20 bp, Artificial Sequence
  Description of Artificial Sequence: Synthetic oligonucleotide
aggcaggcaccaccatgccc

SEQ ID NO: 5413 - DNA, 20 bp, Artificial Sequence
  Description of Artificial Sequence: Synthetic oligonucleotide
ggcaggcaccaccatgccca

SEQ ID NO: 5414 - DNA, 20 bp, Artificial Sequence
  Description of Artificial Sequence: Synthetic oligonucleotide
gcaggcaccaccatgcccag

SEQ ID NO: 5415 - DNA, 20 bp, Artificial Sequence
  Description of Artificial Sequence: Synthetic oligonucleotide
caggcaccaccatgcccagc

SEQ ID NO: 5416 - DNA, 20 bp, Artificial Sequence
  Description of Artificial Sequence: Synthetic oligonucleotide
aggcaccaccatgcccagct

SEQ ID NO: 5417 - DNA, 20 bp, Artificial Sequence
  Description of Artificial Sequence: Synthetic oligonucleotide
ggcaccaccatgcccagcta

SEQ ID NO: 5418 - DNA, 20 bp, Artificial Sequence
  Description of Artificial Sequence: Synthetic oligonucleotide
gcaccaccatgcccagctag

SEQ ID NO: 5419 - DNA, 20 bp, Artificial Sequence
  Description of Artificial Sequence: Synthetic oligonucleotide
caccaccatgcccagctagt

SEQ ID NO: 5420 - DNA, 20 bp, Artificial Sequence
  Description of Artificial Sequence: Synthetic oligonucleotide
accaccatgcccagctagtt

SEQ ID NO: 5421 - DNA, 20 bp, Artificial Sequence
  Description of Artificial Sequence: Synthetic oligonucleotide
ccaccatgcccagctagttt

SEQ ID NO: 5422 - DNA, 20 bp, Artificial Sequence
  Description of Artificial Sequence: Synthetic oligonucleotide
caccatgcccagctagtttt

SEQ ID NO: 5423 - DNA, 20 bp, Artificial Sequence
  Description of Artificial Sequence: Synthetic oligonucleotide
accatgcccagctagttttt

SEQ ID NO: 5424 - DNA, 20 bp, Artificial Sequence
  Description of Artificial Sequence: Synthetic oligonucleotide
ccatgcccagctagtttttt

SEQ ID NO: 5425 - DNA, 20 bp, Artificial Sequence
  Description of Artificial Sequence: Synthetic oligonucleotide
catgcccagctagttttttg

SEQ ID NO: 5426 - DNA, 20 bp, Artificial Sequence
  Description of Artificial Sequence: Synthetic oligonucleotide
atgcccagctagttttttgt

SEQ ID NO: 5427 - DNA, 20 bp, Artificial Sequence
  Description of Artificial Sequence: Synthetic oligonucleotide
tgcccagctagttttttgta

SEQ ID NO: 5428 - DNA, 20 bp, Artificial Sequence
  Description of Artificial Sequence: Synthetic oligonucleotide
gcccagctagttttttgtat

SEQ ID NO: 5429 - DNA, 20 bp, Artificial Sequence
  Description of Artificial Sequence: Synthetic oligonucleotide
cccagctagttttttgtatt

SEQ ID NO: 5430 - DNA, 20 bp, Artificial Sequence
  Description of Artificial Sequence: Synthetic oligonucleotide
ccagctagttttttgtattt

SEQ ID NO: 5431 - DNA, 20 bp, Artificial Sequence
  Description of Artificial Sequence: Synthetic oligonucleotide
cagctagttttttgtatttt

SEQ ID NO: 5432 - DNA, 20 bp, Artificial Sequence
  Description of Artificial Sequence: Synthetic oligonucleotide
agctagttttttgtattttt

SEQ ID NO: 5433 - DNA, 20 bp, Artificial Sequence
  Description of Artificial Sequence: Synthetic oligonucleotide
gctagttttttgtattttta

SEQ ID NO: 5434 - DNA, 20 bp, Artificial Sequence
  Description of Artificial Sequence: Synthetic oligonucleotide
ctagttttttgtatttttaa

SEQ ID NO: 5435 - DNA, 20 bp, Artificial Sequence
  Description of Artificial Sequence: Synthetic oligonucleotide
tagttttttgtatttttaat

SEQ ID NO: 5436 - DNA, 20 bp, Artificial Sequence
  Description of Artificial Sequence: Synthetic oligonucleotide
agttttttgtatttttaatt

SEQ ID NO: 5437 - DNA, 20 bp, Artificial Sequence
  Description of Artificial Sequence: Synthetic oligonucleotide
gttttttgtatttttaattg

SEQ ID NO: 5438 - DNA, 20 bp, Artificial Sequence
  Description of Artificial Sequence: Synthetic oligonucleotide
ttttttgtatttttaattga

SEQ ID NO: 5439 - DNA, 20 bp, Artificial Sequence
  Description of Artificial Sequence: Synthetic oligonucleotide
tttttgtatttttaattgag

SEQ ID NO: 5440 - DNA, 20 bp, Artificial Sequence
  Description of Artificial Sequence: Synthetic oligonucleotide
ttttgtatttttaattgaga

SEQ ID NO: 5441 - DNA, 20 bp, Artificial Sequence
  Description of Artificial Sequence: Synthetic oligonucleotide
tttgtatttttaattgagac

SEQ ID NO: 5442 - DNA, 20 bp, Artificial Sequence
  Description of Artificial Sequence: Synthetic oligonucleotide
ttgtatttttaattgagaca

SEQ ID NO: 5443 - DNA, 20 bp, Artificial Sequence
  Description of Artificial Sequence: Synthetic oligonucleotide
tgtatttttaattgagacag

SEQ ID NO: 5444 - DNA, 20 bp, Artificial Sequence
  Description of Artificial Sequence: Synthetic oligonucleotide
gtatttttaattgagacagg

SEQ ID NO: 5445 - DNA, 20 bp, Artificial Sequence
  Description of Artificial Sequence: Synthetic oligonucleotide
tatttttaattgagacagga

SEQ ID NO: 5446 - DNA, 20 bp, Artificial Sequence
  Description of Artificial Sequence: Synthetic oligonucleotide
atttttaattgagacaggat

SEQ ID NO: 5447 - DNA, 20 bp, Artificial Sequence
  Description of Artificial Sequence: Synthetic oligonucleotide
tttttaattgagacaggatt

SEQ ID NO: 5448 - DNA, 20 bp, Artificial Sequence
  Description of Artificial Sequence: Synthetic oligonucleotide
ttttaattgagacaggattt

SEQ ID NO: 5449 - DNA, 20 bp, Artificial Sequence
  Description of Artificial Sequence: Synthetic oligonucleotide
tttaattgagacaggatttc

SEQ ID NO: 5450 - DNA, 20 bp, Artificial Sequence
  Description of Artificial Sequence: Synthetic oligonucleotide
ttaattgagacaggatttcg

SEQ ID NO: 5451 - DNA, 20 bp, Artificial Sequence
  Description of Artificial Sequence: Synthetic oligonucleotide
taattgagacaggatttcgc

SEQ ID NO: 5452 - DNA, 20 bp, Artificial Sequence
  Description of Artificial Sequence: Synthetic oligonucleotide
aattgagacaggatttcgcc

SEQ ID NO: 5453 - DNA, 20 bp, Artificial Sequence
  Description of Artificial Sequence: Synthetic oligonucleotide
attgagacaggatttcgccc

SEQ ID NO: 5454 - DNA, 20 bp, Artificial Sequence
  Description of Artificial Sequence: Synthetic oligonucleotide
ttgagacaggatttcgccct

SEQ ID NO: 5455 - DNA, 20 bp, Artificial Sequence
  Description of Artificial Sequence: Synthetic oligonucleotide
tgagacaggatttcgccctg

SEQ ID NO: 5456 - DNA, 20 bp, Artificial Sequence
  Description of Artificial Sequence: Synthetic oligonucleotide
gagacaggatttcgccctgt

SEQ ID NO: 5457 - DNA, 20 bp, Artificial Sequence
  Description of Artificial Sequence: Synthetic oligonucleotide
agacaggatttcgccctgtt

SEQ ID NO: 5458 - DNA, 20 bp, Artificial Sequence
  Description of Artificial Sequence: Synthetic oligonucleotide
gacaggatttcgccctgttg

SEQ ID NO: 5459 - DNA, 20 bp, Artificial Sequence
  Description of Artificial Sequence: Synthetic oligonucleotide
acaggatttcgccctgttgc

SEQ ID NO: 5460 - DNA, 20 bp, Artificial Sequence
  Description of Artificial Sequence: Synthetic oligonucleotide
caggatttcgccctgttgct

SEQ ID NO: 5461 - DNA, 20 bp, Artificial Sequence
  Description of Artificial Sequence: Synthetic oligonucleotide
aggatttcgccctgttgctc

SEQ ID NO: 5462 - DNA, 20 bp, Artificial Sequence
  Description of Artificial Sequence: Synthetic oligonucleotide
ggatttcgccctgttgctca

SEQ ID NO: 5463 - DNA, 20 bp, Artificial Sequence
  Description of Artificial Sequence: Synthetic oligonucleotide
gatttcgccctgttgctcag

SEQ ID NO: 5464 - DNA, 20 bp, Artificial Sequence
  Description of Artificial Sequence: Synthetic oligonucleotide
atttcgccctgttgctcaga

SEQ ID NO: 5465 - DNA, 20 bp, Artificial Sequence
  Description of Artificial Sequence: Synthetic oligonucleotide
tttcgccctgttgctcagat

SEQ ID NO: 5466 - DNA, 20 bp, Artificial Sequence
  Description of Artificial Sequence: Synthetic oligonucleotide
ttcgccctgttgctcagatt

SEQ ID NO: 5467 - DNA, 20 bp, Artificial Sequence
  Description of Artificial Sequence: Synthetic oligonucleotide
tcgccctgttgctcagattg

SEQ ID NO: 5468 - DNA, 20 bp, Artificial Sequence
  Description of Artificial Sequence: Synthetic oligonucleotide
cgccctgttgctcagattgg

SEQ ID NO: 5469 - DNA, 20 bp, Artificial Sequence
  Description of Artificial Sequence: Synthetic oligonucleotide
gccctgttgctcagattggt

SEQ ID NO: 5470 - DNA, 20 bp, Artificial Sequence
  Description of Artificial Sequence: Synthetic oligonucleotide
ccctgttgctcagattggtc

SEQ ID NO: 5471 - DNA, 20 bp, Artificial Sequence
  Description of Artificial Sequence: Synthetic oligonucleotide
cctgttgctcagattggtct

SEQ ID NO: 5472 - DNA, 20 bp, Artificial Sequence
  Description of Artificial Sequence: Synthetic oligonucleotide
ctgttgctcagattggtctc

SEQ ID NO: 5473 - DNA, 20 bp, Artificial Sequence
  Description of Artificial Sequence: Synthetic oligonucleotide
tgttgctcagattggtctcc

SEQ ID NO: 5474 - DNA, 20 bp, Artificial Sequence
  Description of Artificial Sequence: Synthetic oligonucleotide
gttgctcagattggtctcct

SEQ ID NO: 5475 - DNA, 20 bp, Artificial Sequence
  Description of Artificial Sequence: Synthetic oligonucleotide
ttgctcagattggtctcctg

SEQ ID NO: 5476 - DNA, 20 bp, Artificial Sequence
  Description of Artificial Sequence: Synthetic oligonucleotide
tgctcagattggtctcctgg

SEQ ID NO: 5477 - DNA, 20 bp, Artificial Sequence
  Description of Artificial Sequence: Synthetic oligonucleotide
gctcagattggtctcctggg

SEQ ID NO: 5478 - DNA, 20 bp, Artificial Sequence
  Description of Artificial Sequence: Synthetic oligonucleotide
ctcagattggtctcctgggc

SEQ ID NO: 5479 - DNA, 20 bp, Artificial Sequence
  Description of Artificial Sequence: Synthetic oligonucleotide
tcagattggtctcctgggct

SEQ ID NO: 5480 - DNA, 20 bp, Artificial Sequence
  Description of Artificial Sequence: Synthetic oligonucleotide
cagattggtctcctgggctc

SEQ ID NO: 5481 - DNA, 20 bp, Artificial Sequence
  Description of Artificial Sequence: Synthetic oligonucleotide
agattggtctcctgggctca

SEQ ID NO: 5482 - DNA, 20 bp, Artificial Sequence
  Description of Artificial Sequence: Synthetic oligonucleotide
gattggtctcctgggctcaa

SEQ ID NO: 5483 - DNA, 20 bp, Artificial Sequence
  Description of Artificial Sequence: Synthetic oligonucleotide
attggtctcctgggctcaag

SEQ ID NO: 5484 - DNA, 20 bp, Artificial Sequence
  Description of Artificial Sequence: Synthetic oligonucleotide
ttggtctcctgggctcaagt

SEQ ID NO: 5485 - DNA, 20 bp, Artificial Sequence
  Description of Artificial Sequence: Synthetic oligonucleotide
tggtctcctgggctcaagtg

SEQ ID NO: 5486 - DNA, 20 bp, Artificial Sequence
  Description of Artificial Sequence: Synthetic oligonucleotide
ggtctcctgggctcaagtga

SEQ ID NO: 5487 - DNA, 20 bp, Artificial Sequence
  Description of Artificial Sequence: Synthetic oligonucleotide
gtctcctgggctcaagtgat

SEQ ID NO: 5488 - DNA, 20 bp, Artificial Sequence
  Description of Artificial Sequence: Synthetic oligonucleotide
tctcctgggctcaagtgatc

SEQ ID NO: 5489 - DNA, 20 bp, Artificial Sequence
  Description of Artificial Sequence: Synthetic oligonucleotide
ctcctgggctcaagtgatcc

SEQ ID NO: 5490 - DNA, 20 bp, Artificial Sequence
  Description of Artificial Sequence: Synthetic oligonucleotide
tcctgggctcaagtgatcca

SEQ ID NO: 5491 - DNA, 20 bp, Artificial Sequence
  Description of Artificial Sequence: Synthetic oligonucleotide
cctgggctcaagtgatccac

SEQ ID NO: 5492 - DNA, 20 bp, Artificial Sequence
  Description of Artificial Sequence: Synthetic oligonucleotide
ctgggctcaagtgatccact

SEQ ID NO: 5493 - DNA, 20 bp, Artificial Sequence
  Description of Artificial Sequence: Synthetic oligonucleotide
tgggctcaagtgatccactc

SEQ ID NO: 5494 - DNA, 20 bp, Artificial Sequence
  Description of Artificial Sequence: Synthetic oligonucleotide
gggctcaagtgatccactcg

SEQ ID NO: 5495 - DNA, 20 bp, Artificial Sequence
  Description of Artificial Sequence: Synthetic oligonucleotide
ggctcaagtgatccactcgc

SEQ ID NO: 5496 - DNA, 20 bp, Artificial Sequence
  Description of Artificial Sequence: Synthetic oligonucleotide
gctcaagtgatccactcgct

SEQ ID NO: 5497 - DNA, 20 bp, Artificial Sequence
  Description of Artificial Sequence: Synthetic oligonucleotide
ctcaagtgatccactcgctt

SEQ ID NO: 5498 - DNA, 20 bp, Artificial Sequence
  Description of Artificial Sequence: Synthetic oligonucleotide
tcaagtgatccactcgcttc

SEQ ID NO: 5499 - DNA, 20 bp, Artificial Sequence
  Description of Artificial Sequence: Synthetic oligonucleotide
caagtgatccactcgcttca

SEQ ID NO: 5500 - DNA, 20 bp, Artificial Sequence
  Description of Artificial Sequence: Synthetic oligonucleotide
aagtgatccactcgcttcag

SEQ ID NO: 5501 - DNA, 20 bp, Artificial Sequence
  Description of Artificial Sequence: Synthetic oligonucleotide
agtgatccactcgcttcagc

SEQ ID NO: 5502 - DNA, 20 bp, Artificial Sequence
  Description of Artificial Sequence: Synthetic oligonucleotide
gtgatccactcgcttcagcc

SEQ ID NO: 5503 - DNA, 20 bp, Artificial Sequence
  Description of Artificial Sequence: Synthetic oligonucleotide
tgatccactcgcttcagcct

SEQ ID NO: 5504 - DNA, 20 bp, Artificial Sequence
  Description of Artificial Sequence: Synthetic oligonucleotide
gatccactcgcttcagcctc

SEQ ID NO: 5505 - DNA, 20 bp, Artificial Sequence
  Description of Artificial Sequence: Synthetic oligonucleotide
atccactcgcttcagcctcc

SEQ ID NO: 5506 - DNA, 20 bp, Artificial Sequence
  Description of Artificial Sequence: Synthetic oligonucleotide
tccactcgcttcagcctccc

SEQ ID NO: 5507 - DNA, 20 bp, Artificial Sequence
  Description of Artificial Sequence: Synthetic oligonucleotide
ccactcgcttcagcctccca

SEQ ID NO: 5508 - DNA, 20 bp, Artificial Sequence
  Description of Artificial Sequence: Synthetic oligonucleotide
cactcgcttcagcctcccaa

SEQ ID NO: 5509 - DNA, 20 bp, Artificial Sequence
  Description of Artificial Sequence: Synthetic oligonucleotide
actcgcttcagcctcccaaa

SEQ ID NO: 5510 - DNA, 20 bp, Artificial Sequence
  Description of Artificial Sequence: Synthetic oligonucleotide
ctcgcttcagcctcccaaag

SEQ ID NO: 5511 - DNA, 20 bp, Artificial Sequence
  Description of Artificial Sequence: Synthetic oligonucleotide
tcgcttcagcctcccaaagt

SEQ ID NO: 5512 - DNA, 20 bp, Artificial Sequence
  Description of Artificial Sequence: Synthetic oligonucleotide
cgcttcagcctcccaaagtg

SEQ ID NO: 5513 - DNA, 20 bp, Artificial Sequence
  Description of Artificial Sequence: Synthetic oligonucleotide
gcttcagcctcccaaagtgc

SEQ ID NO: 5514 - DNA, 20 bp, Artificial Sequence
  Description of Artificial Sequence: Synthetic oligonucleotide
cttcagcctcccaaagtgct

SEQ ID NO: 5515 - DNA, 20 bp, Artificial Sequence
  Description of Artificial Sequence: Synthetic oligonucleotide
ttcagcctcccaaagtgctg

SEQ ID NO: 5516 - DNA, 20 bp, Artificial Sequence
  Description of Artificial Sequence: Synthetic oligonucleotide
tcagcctcccaaagtgctgg

SEQ ID NO: 5517 - DNA, 20 bp, Artificial Sequence
  Description of Artificial Sequence: Synthetic oligonucleotide
cagcctcccaaagtgctggg

SEQ ID NO: 5518 - DNA, 20 bp, Artificial Sequence
  Description of Artificial Sequence: Synthetic oligonucleotide
agcctcccaaagtgctggga

SEQ ID NO: 5519 - DNA, 20 bp, Artificial Sequence
  Description of Artificial Sequence: Synthetic oligonucleotide
gcctcccaaagtgctgggat

SEQ ID NO: 5520 - DNA, 20 bp, Artificial Sequence
  Description of Artificial Sequence: Synthetic oligonucleotide
cctcccaaagtgctgggatt

SEQ ID NO: 5521 - DNA, 20 bp, Artificial Sequence
  Description of Artificial Sequence: Synthetic oligonucleotide
ctcccaaagtgctgggattg

SEQ ID NO: 5522 - DNA, 20 bp, Artificial Sequence
  Description of Artificial Sequence: Synthetic oligonucleotide
tcccaaagtgctgggattgc

SEQ ID NO: 5523 - DNA, 20 bp, Artificial Sequence
  Description of Artificial Sequence: Synthetic oligonucleotide
cccaaagtgctgggattgca

SEQ ID NO: 5524 - DNA, 20 bp, Artificial Sequence
  Description of Artificial Sequence: Synthetic oligonucleotide
ccaaagtgctgggattgcaa

SEQ ID NO: 5525 - DNA, 20 bp, Artificial Sequence
  Description of Artificial Sequence: Synthetic oligonucleotide
caaagtgctgggattgcaag

SEQ ID NO: 5526 - DNA, 20 bp, Artificial Sequence
  Description of Artificial Sequence: Synthetic oligonucleotide
aaagtgctgggattgcaagt

SEQ ID NO: 5527 - DNA, 20 bp, Artificial Sequence
  Description of Artificial Sequence: Synthetic oligonucleotide
aagtgctgggattgcaagtg

SEQ ID NO: 5528 - DNA, 20 bp, Artificial Sequence
  Description of Artificial Sequence: Synthetic oligonucleotide
agtgctgggattgcaagtgt

SEQ ID NO: 5529 - DNA, 20 bp, Artificial Sequence
  Description of Artificial Sequence: Synthetic oligonucleotide
gtgctgggattgcaagtgtg

SEQ ID NO: 5530 - DNA, 20 bp, Artificial Sequence
  Description of Artificial Sequence: Synthetic oligonucleotide
tgctgggattgcaagtgtga

SEQ ID NO: 5531 - DNA, 20 bp, Artificial Sequence
  Description of Artificial Sequence: Synthetic oligonucleotide
gctgggattgcaagtgtgag

SEQ ID NO: 5532 - DNA, 20 bp, Artificial Sequence
  Description of Artificial Sequence: Synthetic oligonucleotide
ctgggattgcaagtgtgagc

SEQ ID NO: 5533 - DNA, 20 bp, Artificial Sequence
  Description of Artificial Sequence: Synthetic oligonucleotide
tgggattgcaagtgtgagcc

SEQ ID NO: 5534 - DNA, 20 bp, Artificial Sequence
  Description of Artificial Sequence: Synthetic oligonucleotide
gggattgcaagtgtgagcca

SEQ ID NO: 5535 - DNA, 20 bp, Artificial Sequence
  Description of Artificial Sequence: Synthetic oligonucleotide
ggattgcaagtgtgagccac

SEQ ID NO: 5536 - DNA, 20 bp, Artificial Sequence
  Description of Artificial Sequence: Synthetic oligonucleotide
gattgcaagtgtgagccacc

SEQ ID NO: 5537 - DNA, 20 bp, Artificial Sequence
  Description of Artificial Sequence: Synthetic oligonucleotide
attgcaagtgtgagccaccg

SEQ ID NO: 5538 - DNA, 20 bp, Artificial Sequence
  Description of Artificial Sequence: Synthetic oligonucleotide
ttgcaagtgtgagccaccgt

SEQ ID NO: 5539 - DNA, 20 bp, Artificial Sequence
  Description of Artificial Sequence: Synthetic oligonucleotide
tgcaagtgtgagccaccgtg

SEQ ID NO: 5540 - DNA, 20 bp, Artificial Sequence
  Description of Artificial Sequence: Synthetic oligonucleotide
gcaagtgtgagccaccgtgc

SEQ ID NO: 5541 - DNA, 20 bp, Artificial Sequence
  Description of Artificial Sequence: Synthetic oligonucleotide
caagtgtgagccaccgtgcc

SEQ ID NO: 5542 - DNA, 20 bp, Artificial Sequence
  Description of Artificial Sequence: Synthetic oligonucleotide
aagtgtgagccaccgtgcct

SEQ ID NO: 5543 - DNA, 20 bp, Artificial Sequence
  Description of Artificial Sequence: Synthetic oligonucleotide
agtgtgagccaccgtgccta

SEQ ID NO: 5544 - DNA, 20 bp, Artificial Sequence
  Description of Artificial Sequence: Synthetic oligonucleotide
gtgtgagccaccgtgcctaa

SEQ ID NO: 5545 - DNA, 20 bp, Artificial Sequence
  Description of Artificial Sequence: Synthetic oligonucleotide
tgtgagccaccgtgcctaat

SEQ ID NO: 5546 - DNA, 20 bp, Artificial Sequence
  Description of Artificial Sequence: Synthetic oligonucleotide
gtgagccaccgtgcctaatt

SEQ ID NO: 5547 - DNA, 20 bp, Artificial Sequence
  Description of Artificial Sequence: Synthetic oligonucleotide
tgagccaccgtgcctaattt

SEQ ID NO: 5548 - DNA, 20 bp, Artificial Sequence
  Description of Artificial Sequence: Synthetic oligonucleotide
gagccaccgtgcctaatttt

SEQ ID NO: 5549 - DNA, 20 bp, Artificial Sequence
  Description of Artificial Sequence: Synthetic oligonucleotide
agccaccgtgcctaattttt

SEQ ID NO: 5550 - DNA, 20 bp, Artificial Sequence
  Description of Artificial Sequence: Synthetic oligonucleotide
gccaccgtgcctaatttttt

SEQ ID NO: 5551 - DNA, 20 bp, Artificial Sequence
  Description of Artificial Sequence: Synthetic oligonucleotide
ccaccgtgcctaattttttt

SEQ ID NO: 5552 - DNA, 20 bp, Artificial Sequence
  Description of Artificial Sequence: Synthetic oligonucleotide
caccgtgcctaatttttttt

SEQ ID NO: 5553 - DNA, 20 bp, Artificial Sequence
  Description of Artificial Sequence: Synthetic oligonucleotide
accgtgcctaattttttttt

SEQ ID NO: 5554 - DNA, 20 bp, Artificial Sequence
  Description of Artificial Sequence: Synthetic oligonucleotide
ccgtgcctaatttttttttt

SEQ ID NO: 5555 - DNA, 20 bp, Artificial Sequence
  Description of Artificial Sequence: Synthetic oligonucleotide
cgtgcctaattttttttttt

SEQ ID NO: 5556 - DNA, 20 bp, Artificial Sequence
  Description of Artificial Sequence: Synthetic oligonucleotide
gtgcctaatttttttttttt

SEQ ID NO: 5557 - DNA, 20 bp, Artificial Sequence
  Description of Artificial Sequence: Synthetic oligonucleotide
tgcctaattttttttttttt

SEQ ID NO: 5558 - DNA, 20 bp, Artificial Sequence
  Description of Artificial Sequence: Synthetic oligonucleotide
gcctaatttttttttttttt

SEQ ID NO: 5559 - DNA, 20 bp, Artificial Sequence
  Description of Artificial Sequence: Synthetic oligonucleotide
cctaattttttttttttttt

SEQ ID NO: 5560 - DNA, 20 bp, Artificial Sequence
  Description of Artificial Sequence: Synthetic oligonucleotide
ctaatttttttttttttttg

SEQ ID NO: 5561 - DNA, 20 bp, Artificial Sequence
  Description of Artificial Sequence: Synthetic oligonucleotide
taatttttttttttttttga

SEQ ID NO: 5562 - DNA, 20 bp, Artificial Sequence
  Description of Artificial Sequence: Synthetic oligonucleotide
aatttttttttttttttgag

SEQ ID NO: 5563 - DNA, 20 bp, Artificial Sequence
  Description of Artificial Sequence: Synthetic oligonucleotide
atttttttttttttttgaga

SEQ ID NO: 5564 - DNA, 20 bp, Artificial Sequence
  Description of Artificial Sequence: Synthetic oligonucleotide
tttttttttttttttgagaa

SEQ ID NO: 5565 - DNA, 20 bp, Artificial Sequence
  Description of Artificial Sequence: Synthetic oligonucleotide
ttttttttttttttgagaat

SEQ ID NO: 5566 - DNA, 20 bp, Artificial Sequence
  Description of Artificial Sequence: Synthetic oligonucleotide
tttttttttttttgagaatt

SEQ ID NO: 5567 - DNA, 20 bp, Artificial Sequence
  Description of Artificial Sequence: Synthetic oligonucleotide
ttttttttttttgagaattg

SEQ ID NO: 5568 - DNA, 20 bp, Artificial Sequence
  Description of Artificial Sequence: Synthetic oligonucleotide
tttttttttttgagaattgc

SEQ ID NO: 5569 - DNA, 20 bp, Artificial Sequence
  Description of Artificial Sequence: Synthetic oligonucleotide
ttttttttttgagaattgct

SEQ ID NO: 5570 - DNA, 20 bp, Artificial Sequence
  Description of Artificial Sequence: Synthetic oligonucleotide
tttttttttgagaattgctt

SEQ ID NO: 5571 - DNA, 20 bp, Artificial Sequence
  Description of Artificial Sequence: Synthetic oligonucleotide
ttttttttgagaattgcttg

SEQ ID NO: 5572 - DNA, 20 bp, Artificial Sequence
  Description of Artificial Sequence: Synthetic oligonucleotide
tttttttgagaattgcttga

SEQ ID NO: 5573 - DNA, 20 bp, Artificial Sequence
  Description of Artificial Sequence: Synthetic oligonucleotide
ttttttgagaattgcttgaa

SEQ ID NO: 5574 - DNA, 20 bp, Artificial Sequence
  Description of Artificial Sequence: Synthetic oligonucleotide
tttttgagaattgcttgaac

SEQ ID NO: 5575 - DNA, 20 bp, Artificial Sequence
  Description of Artificial Sequence: Synthetic oligonucleotide
ttttgagaattgcttgaacc

SEQ ID NO: 5576 - DNA, 20 bp, Artificial Sequence
  Description of Artificial Sequence: Synthetic oligonucleotide
tttgagaattgcttgaaccc

SEQ ID NO: 5577 - DNA, 20 bp, Artificial Sequence
  Description of Artificial Sequence: Synthetic oligonucleotide
ttgagaattgcttgaacccg

SEQ ID NO: 5578 - DNA, 20 bp, Artificial Sequence
  Description of Artificial Sequence: Synthetic oligonucleotide
tgagaattgcttgaacccgg

SEQ ID NO: 5579 - DNA, 20 bp, Artificial Sequence
  Description of Artificial Sequence: Synthetic oligonucleotide
gagaattgcttgaacccggg

SEQ ID NO: 5580 - DNA, 20 bp, Artificial Sequence
  Description of Artificial Sequence: Synthetic oligonucleotide
agaattgcttgaacccggga

SEQ ID NO: 5581 - DNA, 20 bp, Artificial Sequence
  Description of Artificial Sequence: Synthetic oligonucleotide
gaattgcttgaacccgggag

SEQ ID NO: 5582 - DNA, 20 bp, Artificial Sequence
  Description of Artificial Sequence: Synthetic oligonucleotide
aattgcttgaacccgggagg

SEQ ID NO: 5583 - DNA, 20 bp, Artificial Sequence
  Description of Artificial Sequence: Synthetic oligonucleotide
attgcttgaacccgggaggt

SEQ ID NO: 5584 - DNA, 20 bp, Artificial Sequence
  Description of Artificial Sequence: Synthetic oligonucleotide
ttgcttgaacccgggaggtg

SEQ ID NO: 5585 - DNA, 20 bp, Artificial Sequence
  Description of Artificial Sequence: Synthetic oligonucleotide
tgcttgaacccgggaggtgg

SEQ ID NO: 5586 - DNA, 20 bp, Artificial Sequence
  Description of Artificial Sequence: Synthetic oligonucleotide
gcttgaacccgggaggtgga

SEQ ID NO: 5587 - DNA, 20 bp, Artificial Sequence
  Description of Artificial Sequence: Synthetic oligonucleotide
cttgaacccgggaggtggag

SEQ ID NO: 5588 - DNA, 20 bp, Artificial Sequence
  Description of Artificial Sequence: Synthetic oligonucleotide
ttgaacccgggaggtggagg

SEQ ID NO: 5589 - DNA, 20 bp, Artificial Sequence
  Description of Artificial Sequence: Synthetic oligonucleotide
tgaacccgggaggtggaggt

SEQ ID NO: 5590 - DNA, 20 bp, Artificial Sequence
  Description of Artificial Sequence: Synthetic oligonucleotide
gaacccgggaggtggaggtt

SEQ ID NO: 5591 - DNA, 20 bp, Artificial Sequence
  Description of Artificial Sequence: Synthetic oligonucleotide
aacccgggaggtggaggttg

SEQ ID NO: 5592 - DNA, 20 bp, Artificial Sequence
  Description of Artificial Sequence: Synthetic oligonucleotide
acccgggaggtggaggttgc

SEQ ID NO: 5593 - DNA, 20 bp, Artificial Sequence
  Description of Artificial Sequence: Synthetic oligonucleotide
cccgggaggtggaggttgca

SEQ ID NO: 5594 - DNA, 20 bp, Artificial Sequence
  Description of Artificial Sequence: Synthetic oligonucleotide
ccgggaggtggaggttgcag

SEQ ID NO: 5595 - DNA, 20 bp, Artificial Sequence
  Description of Artificial Sequence: Synthetic oligonucleotide
cgggaggtggaggttgcagt

SEQ ID NO: 5596 - DNA, 20 bp, Artificial Sequence
  Description of Artificial Sequence: Synthetic oligonucleotide
gggaggtggaggttgcagtg

SEQ ID NO: 5597 - DNA, 20 bp, Artificial Sequence
  Description of Artificial Sequence: Synthetic oligonucleotide
ggaggtggaggttgcagtga

SEQ ID NO: 5598 - DNA, 20 bp, Artificial Sequence
  Description of Artificial Sequence: Synthetic oligonucleotide
gaggtggaggttgcagtgag

SEQ ID NO: 5599 - DNA, 20 bp, Artificial Sequence
  Description of Artificial Sequence: Synthetic oligonucleotide
aggtggaggttgcagtgagc

SEQ ID NO: 5600 - DNA, 20 bp, Artificial Sequence
  Description of Artificial Sequence: Synthetic oligonucleotide
ggtggaggttgcagtgagcc

SEQ ID NO: 5601 - DNA, 20 bp, Artificial Sequence
  Description of Artificial Sequence: Synthetic oligonucleotide
gtggaggttgcagtgagccg

SEQ ID NO: 5602 - DNA, 20 bp, Artificial Sequence
  Description of Artificial Sequence: Synthetic oligonucleotide
tggaggttgcagtgagccga

SEQ ID NO: 5603 - DNA, 20 bp, Artificial Sequence
  Description of Artificial Sequence: Synthetic oligonucleotide
ggaggttgcagtgagccgag

SEQ ID NO: 5604 - DNA, 20 bp, Artificial Sequence
  Description of Artificial Sequence: Synthetic oligonucleotide
gaggttgcagtgagccgaga

SEQ ID NO: 5605 - DNA, 20 bp, Artificial Sequence
  Description of Artificial Sequence: Synthetic oligonucleotide
aggttgcagtgagccgagat

SEQ ID NO: 5606 - DNA, 20 bp, Artificial Sequence
  Description of Artificial Sequence: Synthetic oligonucleotide
ggttgcagtgagccgagatc

SEQ ID NO: 5607 - DNA, 20 bp, Artificial Sequence
  Description of Artificial Sequence: Synthetic oligonucleotide
gttgcagtgagccgagatcg

SEQ ID NO: 5608 - DNA, 20 bp, Artificial Sequence
  Description of Artificial Sequence: Synthetic oligonucleotide
ttgcagtgagccgagatcgc

SEQ ID NO: 5609 - DNA, 20 bp, Artificial Sequence
  Description of Artificial Sequence: Synthetic oligonucleotide
tgcagtgagccgagatcgca

SEQ ID NO: 5610 - DNA, 20 bp, Artificial Sequence
  Description of Artificial Sequence: Synthetic oligonucleotide
gcagtgagccgagatcgcac

SEQ ID NO: 5611 - DNA, 20 bp, Artificial Sequence
  Description of Artificial Sequence: Synthetic oligonucleotide
cagtgagccgagatcgcacc

SEQ ID NO: 5612 - DNA, 20 bp, Artificial Sequence
  Description of Artificial Sequence: Synthetic oligonucleotide
agtgagccgagatcgcacca

SEQ ID NO: 5613 - DNA, 20 bp, Artificial Sequence
  Description of Artificial Sequence: Synthetic oligonucleotide
gtgagccgagatcgcaccac

SEQ ID NO: 5614 - DNA, 20 bp, Artificial Sequence
  Description of Artificial Sequence: Synthetic oligonucleotide
tgagccgagatcgcaccact

SEQ ID NO: 5615 - DNA, 20 bp, Artificial Sequence
  Description of Artificial Sequence: Synthetic oligonucleotide
gagccgagatcgcaccactg

SEQ ID NO: 5616 - DNA, 20 bp, Artificial Sequence
  Description of Artificial Sequence: Synthetic oligonucleotide
agccgagatcgcaccactgc

SEQ ID NO: 5617 - DNA, 20 bp, Artificial Sequence
  Description of Artificial Sequence: Synthetic oligonucleotide
gccgagatcgcaccactgca

SEQ ID NO: 5618 - DNA, 20 bp, Artificial Sequence
  Description of Artificial Sequence: Synthetic oligonucleotide
ccgagatcgcaccactgcac

SEQ ID NO: 5619 - DNA, 20 bp, Artificial Sequence
  Description of Artificial Sequence: Synthetic oligonucleotide
cgagatcgcaccactgcact

SEQ ID NO: 5620 - DNA, 20 bp, Artificial Sequence
  Description of Artificial Sequence: Synthetic oligonucleotide
gagatcgcaccactgcactc

SEQ ID NO: 5621 - DNA, 20 bp, Artificial Sequence
  Description of Artificial Sequence: Synthetic oligonucleotide
agatcgcaccactgcactcc

SEQ ID NO: 5622 - DNA, 20 bp, Artificial Sequence
  Description of Artificial Sequence: Synthetic oligonucleotide
gatcgcaccactgcactcca

SEQ ID NO: 5623 - DNA, 20 bp, Artificial Sequence
  Description of Artificial Sequence: Synthetic oligonucleotide
atcgcaccactgcactccag

SEQ ID NO: 5624 - DNA, 20 bp, Artificial Sequence
  Description of Artificial Sequence: Synthetic oligonucleotide
tcgcaccactgcactccagc

SEQ ID NO: 5625 - DNA, 20 bp, Artificial Sequence
  Description of Artificial Sequence: Synthetic oligonucleotide
cgcaccactgcactccagct

SEQ ID NO: 5626 - DNA, 20 bp, Artificial Sequence
  Description of Artificial Sequence: Synthetic oligonucleotide
gcaccactgcactccagctt

SEQ ID NO: 5627 - DNA, 20 bp, Artificial Sequence
  Description of Artificial Sequence: Synthetic oligonucleotide
caccactgcactccagctta

SEQ ID NO: 5628 - DNA, 20 bp, Artificial Sequence
  Description of Artificial Sequence: Synthetic oligonucleotide
accactgcactccagcttag

SEQ ID NO: 5629 - DNA, 20 bp, Artificial Sequence
  Description of Artificial Sequence: Synthetic oligonucleotide
ccactgcactccagcttagg

SEQ ID NO: 5630 - DNA, 20 bp, Artificial Sequence
  Description of Artificial Sequence: Synthetic oligonucleotide
cactgcactccagcttaggc

SEQ ID NO: 5631 - DNA, 20 bp, Artificial Sequence
  Description of Artificial Sequence: Synthetic oligonucleotide
actgcactccagcttaggca

SEQ ID NO: 5632 - DNA, 20 bp, Artificial Sequence
  Description of Artificial Sequence: Synthetic oligonucleotide
ctgcactccagcttaggcaa

SEQ ID NO: 5633 - DNA, 20 bp, Artificial Sequence
  Description of Artificial Sequence: Synthetic oligonucleotide
tgcactccagcttaggcaac

SEQ ID NO: 5634 - DNA, 20 bp, Artificial Sequence
  Description of Artificial Sequence: Synthetic oligonucleotide
gcactccagcttaggcaaca

SEQ ID NO: 5635 - DNA, 20 bp, Artificial Sequence
  Description of Artificial Sequence: Synthetic oligonucleotide
cactccagcttaggcaacag

SEQ ID NO: 5636 - DNA, 20 bp, Artificial Sequence
  Description of Artificial Sequence: Synthetic oligonucleotide
actccagcttaggcaacaga

SEQ ID NO: 5637 - DNA, 20 bp, Artificial Sequence
  Description of Artificial Sequence: Synthetic oligonucleotide
ctccagcttaggcaacagag

SEQ ID NO: 5638 - DNA, 20 bp, Artificial Sequence
  Description of Artificial Sequence: Synthetic oligonucleotide
tccagcttaggcaacagagt

SEQ ID NO: 5639 - DNA, 20 bp, Artificial Sequence
  Description of Artificial Sequence: Synthetic oligonucleotide
ccagcttaggcaacagagtg

SEQ ID NO: 5640 - DNA, 20 bp, Artificial Sequence
  Description of Artificial Sequence: Synthetic oligonucleotide
cagcttaggcaacagagtga

SEQ ID NO: 5641 - DNA, 20 bp, Artificial Sequence
  Description of Artificial Sequence: Synthetic oligonucleotide
agcttaggcaacagagtgag

SEQ ID NO: 5642 - DNA, 20 bp, Artificial Sequence
  Description of Artificial Sequence: Synthetic oligonucleotide
gcttaggcaacagagtgaga

SEQ ID NO: 5643 - DNA, 20 bp, Artificial Sequence
  Description of Artificial Sequence: Synthetic oligonucleotide
cttaggcaacagagtgagac

SEQ ID NO: 5644 - DNA, 20 bp, Artificial Sequence
  Description of Artificial Sequence: Synthetic oligonucleotide
ttaggcaacagagtgagacc

SEQ ID NO: 5645 - DNA, 20 bp, Artificial Sequence
  Description of Artificial Sequence: Synthetic oligonucleotide
taggcaacagagtgagaccc

SEQ ID NO: 5646 - DNA, 20 bp, Artificial Sequence
  Description of Artificial Sequence: Synthetic oligonucleotide
aggcaacagagtgagaccct

SEQ ID NO: 5647 - DNA, 20 bp, Artificial Sequence
  Description of Artificial Sequence: Synthetic oligonucleotide
ggcaacagagtgagaccctg

SEQ ID NO: 5648 - DNA, 20 bp, Artificial Sequence
  Description of Artificial Sequence: Synthetic oligonucleotide
gcaacagagtgagaccctgt

SEQ ID NO: 5649 - DNA, 20 bp, Artificial Sequence
  Description of Artificial Sequence: Synthetic oligonucleotide
caacagagtgagaccctgtt

SEQ ID NO: 5650 - DNA, 20 bp, Artificial Sequence
  Description of Artificial Sequence: Synthetic oligonucleotide
aacagagtgagaccctgttt

SEQ ID NO: 5651 - DNA, 20 bp, Artificial Sequence
  Description of Artificial Sequence: Synthetic oligonucleotide
acagagtgagaccctgtttc

SEQ ID NO: 5652 - DNA, 20 bp, Artificial Sequence
  Description of Artificial Sequence: Synthetic oligonucleotide
cagagtgagaccctgtttca

SEQ ID NO: 5653 - DNA, 20 bp, Artificial Sequence
  Description of Artificial Sequence: Synthetic oligonucleotide
agagtgagaccctgtttcaa

SEQ ID NO: 5654 - DNA, 20 bp, Artificial Sequence
  Description of Artificial Sequence: Synthetic oligonucleotide
gagtgagaccctgtttcaaa

SEQ ID NO: 5655 - DNA, 20 bp, Artificial Sequence
  Description of Artificial Sequence: Synthetic oligonucleotide
agtgagaccctgtttcaaaa

SEQ ID NO: 5656 - DNA, 20 bp, Artificial Sequence
  Description of Artificial Sequence: Synthetic oligonucleotide
gtgagaccctgtttcaaaaa

SEQ ID NO: 5657 - DNA, 20 bp, Artificial Sequence
  Description of Artificial Sequence: Synthetic oligonucleotide
tgagaccctgtttcaaaaaa

SEQ ID NO: 5658 - DNA, 20 bp, Artificial Sequence
  Description of Artificial Sequence: Synthetic oligonucleotide
gagaccctgtttcaaaaaaa

SEQ ID NO: 5659 - DNA, 20 bp, Artificial Sequence
  Description of Artificial Sequence: Synthetic oligonucleotide
agaccctgtttcaaaaaaaa

SEQ ID NO: 5660 - DNA, 20 bp, Artificial Sequence
  Description of Artificial Sequence: Synthetic oligonucleotide
gaccctgtttcaaaaaaaaa

SEQ ID NO: 5661 - DNA, 20 bp, Artificial Sequence
  Description of Artificial Sequence: Synthetic oligonucleotide
accctgtttcaaaaaaaaaa

SEQ ID NO: 5662 - DNA, 20 bp, Artificial Sequence
  Description of Artificial Sequence: Synthetic oligonucleotide
ccctgtttcaaaaaaaaaaa

SEQ ID NO: 5663 - DNA, 20 bp, Artificial Sequence
  Description of Artificial Sequence: Synthetic oligonucleotide
cctgtttcaaaaaaaaaaaa

SEQ ID NO: 5664 - DNA, 20 bp, Artificial Sequence
  Description of Artificial Sequence: Synthetic oligonucleotide
ctgtttcaaaaaaaaaaaaa

SEQ ID NO: 5665 - DNA, 20 bp, Artificial Sequence
  Description of Artificial Sequence: Synthetic oligonucleotide
tgtttcaaaaaaaaaaaaaa

SEQ ID NO: 5666 - DNA, 20 bp, Artificial Sequence
  Description of Artificial Sequence: Synthetic oligonucleotide
gtttcaaaaaaaaaaaaaaa

SEQ ID NO: 5667 - DNA, 20 bp, Artificial Sequence
  Description of Artificial Sequence: Synthetic oligonucleotide
tttcaaaaaaaaaaaaaaaa

SEQ ID NO: 5668 - DNA, 20 bp, Artificial Sequence
  Description of Artificial Sequence: Synthetic oligonucleotide
ttcaaaaaaaaaaaaaaaaa

SEQ ID NO: 5669 - DNA, 20 bp, Artificial Sequence
  Description of Artificial Sequence: Synthetic oligonucleotide
tcaaaaaaaaaaaaaaaaaa

SEQ ID NO: 5670 - DNA, 20 bp, Artificial Sequence
  Description of Artificial Sequence: Synthetic oligonucleotide
caaaaaaaaaaaaaaaaaaa

SEQ ID NO: 5671 - DNA, 20 bp, Artificial Sequence
  Description of Artificial Sequence: Synthetic oligonucleotide
aaaaaaaaaaaaaaaaaaag

SEQ ID NO: 5672 - DNA, 20 bp, Artificial Sequence
  Description of Artificial Sequence: Synthetic oligonucleotide
aaaaaaaaaaaaaaaaaaga

SEQ ID NO: 5673 - DNA, 20 bp, Artificial Sequence
  Description of Artificial Sequence: Synthetic oligonucleotide
aaaaaaaaaaaaaaaaagaa

SEQ ID NO: 5674 - DNA, 20 bp, Artificial Sequence
  Description of Artificial Sequence: Synthetic oligonucleotide
aaaaaaaaaaaaaaaagaat

SEQ ID NO: 5675 - DNA, 20 bp, Artificial Sequence
  Description of Artificial Sequence: Synthetic oligonucleotide
aaaaaaaaaaaaaaagaatc

SEQ ID NO: 5676 - DNA, 20 bp, Artificial Sequence
  Description of Artificial Sequence: Synthetic oligonucleotide
aaaaaaaaaaaaaagaatcc

SEQ ID NO: 5677 - DNA, 20 bp, Artificial Sequence
  Description of Artificial Sequence: Synthetic oligonucleotide
aaaaaaaaaaaaagaatcct

SEQ ID NO: 5678 - DNA, 20 bp, Artificial Sequence
  Description of Artificial Sequence: Synthetic oligonucleotide
aaaaaaaaaaaagaatcctg

SEQ ID NO: 5679 - DNA, 20 bp, Artificial Sequence
  Description of Artificial Sequence: Synthetic oligonucleotide
aaaaaaaaaaagaatcctgt

SEQ ID NO: 5680 - DNA, 20 bp, Artificial Sequence
  Description of Artificial Sequence: Synthetic oligonucleotide
aaaaaaaaaagaatcctgtg

SEQ ID NO: 5681 - DNA, 20 bp, Artificial Sequence
  Description of Artificial Sequence: Synthetic oligonucleotide
aaaaaaaaagaatcctgtgg

SEQ ID NO: 5682 - DNA, 20 bp, Artificial Sequence
  Description of Artificial Sequence: Synthetic oligonucleotide
aaaaaaaagaatcctgtgga

SEQ ID NO: 5683 - DNA, 20 bp, Artificial Sequence
  Description of Artificial Sequence: Synthetic oligonucleotide
aaaaaaagaatcctgtggag

SEQ ID NO: 5684 - DNA, 20 bp, Artificial Sequence
  Description of Artificial Sequence: Synthetic oligonucleotide
aaaaaagaatcctgtggagc

SEQ ID NO: 5685 - DNA, 20 bp, Artificial Sequence
  Description of Artificial Sequence: Synthetic oligonucleotide
aaaaagaatcctgtggagca

SEQ ID NO: 5686 - DNA, 20 bp, Artificial Sequence
  Description of Artificial Sequence: Synthetic oligonucleotide
aaaagaatcctgtggagcac

SEQ ID NO: 5687 - DNA, 20 bp, Artificial Sequence
  Description of Artificial Sequence: Synthetic oligonucleotide
aaagaatcctgtggagcacc

SEQ ID NO: 5688 - DNA, 20 bp, Artificial Sequence
  Description of Artificial Sequence: Synthetic oligonucleotide
aagaatcctgtggagcacca

SEQ ID NO: 5689 - DNA, 20 bp, Artificial Sequence
  Description of Artificial Sequence: Synthetic oligonucleotide
agaatcctgtggagcaccat

SEQ ID NO: 5690 - DNA, 20 bp, Artificial Sequence
  Description of Artificial Sequence: Synthetic oligonucleotide
gaatcctgtggagcaccatt

SEQ ID NO: 5691 - DNA, 20 bp, Artificial Sequence
  Description of Artificial Sequence: Synthetic oligonucleotide
aatcctgtggagcaccatta

SEQ ID NO: 5692 - DNA, 20 bp, Artificial Sequence
  Description of Artificial Sequence: Synthetic oligonucleotide
atcctgtggagcaccattat

SEQ ID NO: 5693 - DNA, 20 bp, Artificial Sequence
  Description of Artificial Sequence: Synthetic oligonucleotide
tcctgtggagcaccattata

SEQ ID NO: 5694 - DNA, 20 bp, Artificial Sequence
  Description of Artificial Sequence: Synthetic oligonucleotide
cctgtggagcaccattataa

SEQ ID NO: 5695 - DNA, 20 bp, Artificial Sequence
  Description of Artificial Sequence: Synthetic oligonucleotide
ctgtggagcaccattataaa

SEQ ID NO: 5696 - DNA, 20 bp, Artificial Sequence
  Description of Artificial Sequence: Synthetic oligonucleotide
tgtggagcaccattataaag

SEQ ID NO: 5697 - DNA, 20 bp, Artificial Sequence
  Description of Artificial Sequence: Synthetic oligonucleotide
gtggagcaccattataaaga

SEQ ID NO: 5698 - DNA, 20 bp, Artificial Sequence
  Description of Artificial Sequence: Synthetic oligonucleotide
tggagcaccattataaagat

SEQ ID NO: 5699 - DNA, 20 bp, Artificial Sequence
  Description of Artificial Sequence: Synthetic oligonucleotide
ggagcaccattataaagatg

SEQ ID NO: 5700 - DNA, 20 bp, Artificial Sequence
  Description of Artificial Sequence: Synthetic oligonucleotide
gagcaccattataaagatgt

SEQ ID NO: 5701 - DNA, 20 bp, Artificial Sequence
  Description of Artificial Sequence: Synthetic oligonucleotide
agcaccattataaagatgtt

SEQ ID NO: 5702 - DNA, 20 bp, Artificial Sequence
  Description of Artificial Sequence: Synthetic oligonucleotide
gcaccattataaagatgttt

SEQ ID NO: 5703 - DNA, 20 bp, Artificial Sequence
  Description of Artificial Sequence: Synthetic oligonucleotide
caccattataaagatgtttg

SEQ ID NO: 5704 - DNA, 20 bp, Artificial Sequence
  Description of Artificial Sequence: Synthetic oligonucleotide
accattataaagatgtttgt

SEQ ID NO: 5705 - DNA, 20 bp, Artificial Sequence
  Description of Artificial Sequence: Synthetic oligonucleotide
ccattataaagatgtttgtg

SEQ ID NO: 5706 - DNA, 20 bp, Artificial Sequence
  Description of Artificial Sequence: Synthetic oligonucleotide
cattataaagatgtttgtgg

SEQ ID NO: 5707 - DNA, 20 bp, Artificial Sequence
  Description of Artificial Sequence: Synthetic oligonucleotide
attataaagatgtttgtggc

SEQ ID NO: 5708 - DNA, 20 bp, Artificial Sequence
  Description of Artificial Sequence: Synthetic oligonucleotide
ttataaagatgtttgtggcc

SEQ ID NO: 5709 - DNA, 20 bp, Artificial Sequence
  Description of Artificial Sequence: Synthetic oligonucleotide
tataaagatgtttgtggccg

SEQ ID NO: 5710 - DNA, 20 bp, Artificial Sequence
  Description of Artificial Sequence: Synthetic oligonucleotide
ataaagatgtttgtggccgg

SEQ ID NO: 5711 - DNA, 20 bp, Artificial Sequence
  Description of Artificial Sequence: Synthetic oligonucleotide
taaagatgtttgtggccggg

SEQ ID NO: 5712 - DNA, 20 bp, Artificial Sequence
  Description of Artificial Sequence: Synthetic oligonucleotide
aaagatgtttgtggccgggt

SEQ ID NO: 5713 - DNA, 20 bp, Artificial Sequence
  Description of Artificial Sequence: Synthetic oligonucleotide
aagatgtttgtggccgggta

SEQ ID NO: 5714 - DNA, 20 bp, Artificial Sequence
  Description of Artificial Sequence: Synthetic oligonucleotide
agatgtttgtggccgggtat

SEQ ID NO: 5715 - DNA, 20 bp, Artificial Sequence
  Description of Artificial Sequence: Synthetic oligonucleotide
gatgtttgtggccgggtatt

SEQ ID NO: 5716 - DNA, 20 bp, Artificial Sequence
  Description of Artificial Sequence: Synthetic oligonucleotide
atgtttgtggccgggtattg

SEQ ID NO: 5717 - DNA, 20 bp, Artificial Sequence
  Description of Artificial Sequence: Synthetic oligonucleotide
tgtttgtggccgggtattgt

SEQ ID NO: 5718 - DNA, 20 bp, Artificial Sequence
  Description of Artificial Sequence: Synthetic oligonucleotide
gtttgtggccgggtattgtg

SEQ ID NO: 5719 - DNA, 20 bp, Artificial Sequence
  Description of Artificial Sequence: Synthetic oligonucleotide
tttgtggccgggtattgtgg

SEQ ID NO: 5720 - DNA, 20 bp, Artificial Sequence
  Description of Artificial Sequence: Synthetic oligonucleotide
ttgtggccgggtattgtggc

SEQ ID NO: 5721 - DNA, 20 bp, Artificial Sequence
  Description of Artificial Sequence: Synthetic oligonucleotide
tgtggccgggtattgtggct

SEQ ID NO: 5722 - DNA, 20 bp, Artificial Sequence
  Description of Artificial Sequence: Synthetic oligonucleotide
gtggccgggtattgtggctc

SEQ ID NO: 5723 - DNA, 20 bp, Artificial Sequence
  Description of Artificial Sequence: Synthetic oligonucleotide
tggccgggtattgtggctca

SEQ ID NO: 5724 - DNA, 20 bp, Artificial Sequence
  Description of Artificial Sequence: Synthetic oligonucleotide
ggccgggtattgtggctcac

SEQ ID NO: 5725 - DNA, 20 bp, Artificial Sequence
  Description of Artificial Sequence: Synthetic oligonucleotide
gccgggtattgtggctcacg

SEQ ID NO: 5726 - DNA, 20 bp, Artificial Sequence
  Description of Artificial Sequence: Synthetic oligonucleotide
ccgggtattgtggctcacgc

SEQ ID NO: 5727 - DNA, 20 bp, Artificial Sequence
  Description of Artificial Sequence: Synthetic oligonucleotide
cgggtattgtggctcacgcc

SEQ ID NO: 5728 - DNA, 20 bp, Artificial Sequence
  Description of Artificial Sequence: Synthetic oligonucleotide
gggtattgtggctcacgcct

SEQ ID NO: 5729 - DNA, 20 bp, Artificial Sequence
  Description of Artificial Sequence: Synthetic oligonucleotide
ggtattgtggctcacgcctg

SEQ ID NO: 5730 - DNA, 20 bp, Artificial Sequence
  Description of Artificial Sequence: Synthetic oligonucleotide
gtattgtggctcacgcctgt

SEQ ID NO: 5731 - DNA, 20 bp, Artificial Sequence
  Description of Artificial Sequence: Synthetic oligonucleotide
tattgtggctcacgcctgta

SEQ ID NO: 5732 - DNA, 20 bp, Artificial Sequence
  Description of Artificial Sequence: Synthetic oligonucleotide
attgtggctcacgcctgtaa

SEQ ID NO: 5733 - DNA, 20 bp, Artificial Sequence
  Description of Artificial Sequence: Synthetic oligonucleotide
ttgtggctcacgcctgtaat

SEQ ID NO: 5734 - DNA, 20 bp, Artificial Sequence
  Description of Artificial Sequence: Synthetic oligonucleotide
tgtggctcacgcctgtaatc

SEQ ID NO: 5735 - DNA, 20 bp, Artificial Sequence
  Description of Artificial Sequence: Synthetic oligonucleotide
gtggctcacgcctgtaatcc

SEQ ID NO: 5736 - DNA, 20 bp, Artificial Sequence
  Description of Artificial Sequence: Synthetic oligonucleotide
tggctcacgcctgtaatccc

SEQ ID NO: 5737 - DNA, 20 bp, Artificial Sequence
  Description of Artificial Sequence: Synthetic oligonucleotide
ggctcacgcctgtaatccca

SEQ ID NO: 5738 - DNA, 20 bp, Artificial Sequence
  Description of Artificial Sequence: Synthetic oligonucleotide
gctcacgcctgtaatcccaa

SEQ ID NO: 5739 - DNA, 20 bp, Artificial Sequence
  Description of Artificial Sequence: Synthetic oligonucleotide
ctcacgcctgtaatcccaac

SEQ ID NO: 5740 - DNA, 20 bp, Artificial Sequence
  Description of Artificial Sequence: Synthetic oligonucleotide
tcacgcctgtaatcccaaca

SEQ ID NO: 5741 - DNA, 20 bp, Artificial Sequence
  Description of Artificial Sequence: Synthetic oligonucleotide
cacgcctgtaatcccaacac

SEQ ID NO: 5742 - DNA, 20 bp, Artificial Sequence
  Description of Artificial Sequence: Synthetic oligonucleotide
acgcctgtaatcccaacact

SEQ ID NO: 5743 - DNA, 20 bp, Artificial Sequence
  Description of Artificial Sequence: Synthetic oligonucleotide
cgcctgtaatcccaacactt

SEQ ID NO: 5744 - DNA, 20 bp, Artificial Sequence
  Description of Artificial Sequence: Synthetic oligonucleotide
gcctgtaatcccaacacttt

SEQ ID NO: 5745 - DNA, 20 bp, Artificial Sequence
  Description of Artificial Sequence: Synthetic oligonucleotide
cctgtaatcccaacactttg

SEQ ID NO: 5746 - DNA, 20 bp, Artificial Sequence
  Description of Artificial Sequence: Synthetic oligonucleotide
ctgtaatcccaacactttgg

SEQ ID NO: 5747 - DNA, 20 bp, Artificial Sequence
  Description of Artificial Sequence: Synthetic oligonucleotide
tgtaatcccaacactttggg

SEQ ID NO: 5748 - DNA, 20 bp, Artificial Sequence
  Description of Artificial Sequence: Synthetic oligonucleotide
gtaatcccaacactttggga

SEQ ID NO: 5749 - DNA, 20 bp, Artificial Sequence
  Description of Artificial Sequence: Synthetic oligonucleotide
taatcccaacactttgggag

SEQ ID NO: 5750 - DNA, 20 bp, Artificial Sequence
  Description of Artificial Sequence: Synthetic oligonucleotide
aatcccaacactttgggagg

SEQ ID NO: 5751 - DNA, 20 bp, Artificial Sequence
  Description of Artificial Sequence: Synthetic oligonucleotide
atcccaacactttgggaggc

SEQ ID NO: 5752 - DNA, 20 bp, Artificial Sequence
  Description of Artificial Sequence: Synthetic oligonucleotide
tcccaacactttgggaggcc

SEQ ID NO: 5753 - DNA, 20 bp, Artificial Sequence
  Description of Artificial Sequence: Synthetic oligonucleotide
cccaacactttgggaggccg

SEQ ID NO: 5754 - DNA, 20 bp, Artificial Sequence
  Description of Artificial Sequence: Synthetic oligonucleotide
ccaacactttgggaggccga

SEQ ID NO: 5755 - DNA, 20 bp, Artificial Sequence
  Description of Artificial Sequence: Synthetic oligonucleotide
caacactttgggaggccgag

SEQ ID NO: 5756 - DNA, 20 bp, Artificial Sequence
  Description of Artificial Sequence: Synthetic oligonucleotide
aacactttgggaggccgagg

SEQ ID NO: 5757 - DNA, 20 bp, Artificial Sequence
  Description of Artificial Sequence: Synthetic oligonucleotide
acactttgggaggccgaggt

SEQ ID NO: 5758 - DNA, 20 bp, Artificial Sequence
  Description of Artificial Sequence: Synthetic oligonucleotide
cactttgggaggccgaggtg

SEQ ID NO: 5759 - DNA, 20 bp, Artificial Sequence
  Description of Artificial Sequence: Synthetic oligonucleotide
actttgggaggccgaggtgg

SEQ ID NO: 5760 - DNA, 20 bp, Artificial Sequence
  Description of Artificial Sequence: Synthetic oligonucleotide
ctttgggaggccgaggtggg

SEQ ID NO: 5761 - DNA, 20 bp, Artificial Sequence
  Description of Artificial Sequence: Synthetic oligonucleotide
tttgggaggccgaggtgggc

SEQ ID NO: 5762 - DNA, 20 bp, Artificial Sequence
  Description of Artificial Sequence: Synthetic oligonucleotide
ttgggaggccgaggtgggca

SEQ ID NO: 5763 - DNA, 20 bp, Artificial Sequence
  Description of Artificial Sequence: Synthetic oligonucleotide
tgggaggccgaggtgggcag

SEQ ID NO: 5764 - DNA, 20 bp, Artificial Sequence
  Description of Artificial Sequence: Synthetic oligonucleotide
gggaggccgaggtgggcaga

SEQ ID NO: 5765 - DNA, 20 bp, Artificial Sequence
  Description of Artificial Sequence: Synthetic oligonucleotide
ggaggccgaggtgggcagat

SEQ ID NO: 5766 - DNA, 20 bp, Artificial Sequence
  Description of Artificial Sequence: Synthetic oligonucleotide
gaggccgaggtgggcagatc

SEQ ID NO: 5767 - DNA, 20 bp, Artificial Sequence
  Description of Artificial Sequence: Synthetic oligonucleotide
aggccgaggtgggcagatca

SEQ ID NO: 5768 - DNA, 20 bp, Artificial Sequence
  Description of Artificial Sequence: Synthetic oligonucleotide
ggccgaggtgggcagatcac

SEQ ID NO: 5769 - DNA, 20 bp, Artificial Sequence
  Description of Artificial Sequence: Synthetic oligonucleotide
gccgaggtgggcagatcact

SEQ ID NO: 5770 - DNA, 20 bp, Artificial Sequence
  Description of Artificial Sequence: Synthetic oligonucleotide
ccgaggtgggcagatcactt

SEQ ID NO: 5771 - DNA, 20 bp, Artificial Sequence
  Description of Artificial Sequence: Synthetic oligonucleotide
cgaggtgggcagatcacttg

SEQ ID NO: 5772 - DNA, 20 bp, Artificial Sequence
  Description of Artificial Sequence: Synthetic oligonucleotide
gaggtgggcagatcacttga

SEQ ID NO: 5773 - DNA, 20 bp, Artificial Sequence
  Description of Artificial Sequence: Synthetic oligonucleotide
aggtgggcagatcacttgag

SEQ ID NO: 5774 - DNA, 20 bp, Artificial Sequence
  Description of Artificial Sequence: Synthetic oligonucleotide
ggtgggcagatcacttgagg

SEQ ID NO: 5775 - DNA, 20 bp, Artificial Sequence
  Description of Artificial Sequence: Synthetic oligonucleotide
gtgggcagatcacttgaggt

SEQ ID NO: 5776 - DNA, 20 bp, Artificial Sequence
  Description of Artificial Sequence: Synthetic oligonucleotide
tgggcagatcacttgaggtc

SEQ ID NO: 5777 - DNA, 20 bp, Artificial Sequence
  Description of Artificial Sequence: Synthetic oligonucleotide
gggcagatcacttgaggtca

SEQ ID NO: 5778 - DNA, 20 bp, Artificial Sequence
  Description of Artificial Sequence: Synthetic oligonucleotide
ggcagatcacttgaggtcag

SEQ ID NO: 5779 - DNA, 20 bp, Artificial Sequence
  Description of Artificial Sequence: Synthetic oligonucleotide
gcagatcacttgaggtcagg

SEQ ID NO: 5780 - DNA, 20 bp, Artificial Sequence
  Description of Artificial Sequence: Synthetic oligonucleotide
cagatcacttgaggtcagga

SEQ ID NO: 5781 - DNA, 20 bp, Artificial Sequence
  Description of Artificial Sequence: Synthetic oligonucleotide
agatcacttgaggtcaggag

SEQ ID NO: 5782 - DNA, 20 bp, Artificial Sequence
  Description of Artificial Sequence: Synthetic oligonucleotide
gatcacttgaggtcaggagt

SEQ ID NO: 5783 - DNA, 20 bp, Artificial Sequence
  Description of Artificial Sequence: Synthetic oligonucleotide
atcacttgaggtcaggagtt

SEQ ID NO: 5784 - DNA, 20 bp, Artificial Sequence
  Description of Artificial Sequence: Synthetic oligonucleotide
tcacttgaggtcaggagttc

SEQ ID NO: 5785 - DNA, 20 bp, Artificial Sequence
  Description of Artificial Sequence: Synthetic oligonucleotide
cacttgaggtcaggagttca

SEQ ID NO: 5786 - DNA, 20 bp, Artificial Sequence
  Description of Artificial Sequence: Synthetic oligonucleotide
acttgaggtcaggagttcaa

SEQ ID NO: 5787 - DNA, 20 bp, Artificial Sequence
  Description of Artificial Sequence: Synthetic oligonucleotide
cttgaggtcaggagttcaag

SEQ ID NO: 5788 - DNA, 20 bp, Artificial Sequence
  Description of Artificial Sequence: Synthetic oligonucleotide
ttgaggtcaggagttcaaga

SEQ ID NO: 5789 - DNA, 20 bp, Artificial Sequence
  Description of Artificial Sequence: Synthetic oligonucleotide
tgaggtcaggagttcaagac

SEQ ID NO: 5790 - DNA, 20 bp, Artificial Sequence
  Description of Artificial Sequence: Synthetic oligonucleotide
gaggtcaggagttcaagacc

SEQ ID NO: 5791 - DNA, 20 bp, Artificial Sequence
  Description of Artificial Sequence: Synthetic oligonucleotide
aggtcaggagttcaagacca

SEQ ID NO: 5792 - DNA, 20 bp, Artificial Sequence
  Description of Artificial Sequence: Synthetic oligonucleotide
ggtcaggagttcaagaccac

SEQ ID NO: 5793 - DNA, 20 bp, Artificial Sequence
  Description of Artificial Sequence: Synthetic oligonucleotide
gtcaggagttcaagaccacc

SEQ ID NO: 5794 - DNA, 20 bp, Artificial Sequence
  Description of Artificial Sequence: Synthetic oligonucleotide
tcaggagttcaagaccaccc

SEQ ID NO: 5795 - DNA, 20 bp, Artificial Sequence
  Description of Artificial Sequence: Synthetic oligonucleotide
caggagttcaagaccaccct

SEQ ID NO: 5796 - DNA, 20 bp, Artificial Sequence
  Description of Artificial Sequence: Synthetic oligonucleotide
aggagttcaagaccaccctg

SEQ ID NO: 5797 - DNA, 20 bp, Artificial Sequence
  Description of Artificial Sequence: Synthetic oligonucleotide
ggagttcaagaccaccctgg

SEQ ID NO: 5798 - DNA, 20 bp, Artificial Sequence
  Description of Artificial Sequence: Synthetic oligonucleotide
gagttcaagaccaccctggc

SEQ ID NO: 5799 - DNA, 20 bp, Artificial Sequence
  Description of Artificial Sequence: Synthetic oligonucleotide
agttcaagaccaccctggcc

SEQ ID NO: 5800 - DNA, 20 bp, Artificial Sequence
  Description of Artificial Sequence: Synthetic oligonucleotide
gttcaagaccaccctggcca

SEQ ID NO: 5801 - DNA, 20 bp, Artificial Sequence
  Description of Artificial Sequence: Synthetic oligonucleotide
ttcaagaccaccctggccaa

SEQ ID NO: 5802 - DNA, 20 bp, Artificial Sequence
  Description of Artificial Sequence: Synthetic oligonucleotide
tcaagaccaccctggccaac

SEQ ID NO: 5803 - DNA, 20 bp, Artificial Sequence
  Description of Artificial Sequence: Synthetic oligonucleotide
caagaccaccctggccaaca

SEQ ID NO: 5804 - DNA, 20 bp, Artificial Sequence
  Description of Artificial Sequence: Synthetic oligonucleotide
aagaccaccctggccaacat

SEQ ID NO: 5805 - DNA, 20 bp, Artificial Sequence
  Description of Artificial Sequence: Synthetic oligonucleotide
agaccaccctggccaacatg

SEQ ID NO: 5806 - DNA, 20 bp, Artificial Sequence
  Description of Artificial Sequence: Synthetic oligonucleotide
gaccaccctggccaacatgg

SEQ ID NO: 5807 - DNA, 20 bp, Artificial Sequence
  Description of Artificial Sequence: Synthetic oligonucleotide
accaccctggccaacatggt

SEQ ID NO: 5808 - DNA, 20 bp, Artificial Sequence
  Description of Artificial Sequence: Synthetic oligonucleotide
ccaccctggccaacatggtg

SEQ ID NO: 5809 - DNA, 20 bp, Artificial Sequence
  Description of Artificial Sequence: Synthetic oligonucleotide
caccctggccaacatggtga

SEQ ID NO: 5810 - DNA, 20 bp, Artificial Sequence
  Description of Artificial Sequence: Synthetic oligonucleotide
accctggccaacatggtgaa

SEQ ID NO: 5811 - DNA, 20 bp, Artificial Sequence
  Description of Artificial Sequence: Synthetic oligonucleotide
ccctggccaacatggtgaaa

SEQ ID NO: 5812 - DNA, 20 bp, Artificial Sequence
  Description of Artificial Sequence: Synthetic oligonucleotide
cctggccaacatggtgaaac

SEQ ID NO: 5813 - DNA, 20 bp, Artificial Sequence
  Description of Artificial Sequence: Synthetic oligonucleotide
ctggccaacatggtgaaacc

SEQ ID NO: 5814 - DNA, 20 bp, Artificial Sequence
  Description of Artificial Sequence: Synthetic oligonucleotide
tggccaacatggtgaaaccc

SEQ ID NO: 5815 - DNA, 20 bp, Artificial Sequence
  Description of Artificial Sequence: Synthetic oligonucleotide
ggccaacatggtgaaacccc

SEQ ID NO: 5816 - DNA, 20 bp, Artificial Sequence
  Description of Artificial Sequence: Synthetic oligonucleotide
gccaacatggtgaaaccccg

SEQ ID NO: 5817 - DNA, 20 bp, Artificial Sequence
  Description of Artificial Sequence: Synthetic oligonucleotide
ccaacatggtgaaaccccgt

SEQ ID NO: 5818 - DNA, 20 bp, Artificial Sequence
  Description of Artificial Sequence: Synthetic oligonucleotide
caacatggtgaaaccccgtc

SEQ ID NO: 5819 - DNA, 20 bp, Artificial Sequence
  Description of Artificial Sequence: Synthetic oligonucleotide
aacatggtgaaaccccgtct

SEQ ID NO: 5820 - DNA, 20 bp, Artificial Sequence
  Description of Artificial Sequence: Synthetic oligonucleotide
acatggtgaaaccccgtctc

SEQ ID NO: 5821 - DNA, 20 bp, Artificial Sequence
  Description of Artificial Sequence: Synthetic oligonucleotide
catggtgaaaccccgtctct

SEQ ID NO: 5822 - DNA, 20 bp, Artificial Sequence
  Description of Artificial Sequence: Synthetic oligonucleotide
atggtgaaaccccgtctcta

SEQ ID NO: 5823 - DNA, 20 bp, Artificial Sequence
  Description of Artificial Sequence: Synthetic oligonucleotide
tggtgaaaccccgtctctac

SEQ ID NO: 5824 - DNA, 20 bp, Artificial Sequence
  Description of Artificial Sequence: Synthetic oligonucleotide
ggtgaaaccccgtctctact

SEQ ID NO: 5825 - DNA, 20 bp, Artificial Sequence
  Description of Artificial Sequence: Synthetic oligonucleotide
gtgaaaccccgtctctacta

SEQ ID NO: 5826 - DNA, 20 bp, Artificial Sequence
  Description of Artificial Sequence: Synthetic oligonucleotide
tgaaaccccgtctctactaa

SEQ ID NO: 5827 - DNA, 20 bp, Artificial Sequence
  Description of Artificial Sequence: Synthetic oligonucleotide
gaaaccccgtctctactaaa

SEQ ID NO: 5828 - DNA, 20 bp, Artificial Sequence
  Description of Artificial Sequence: Synthetic oligonucleotide
aaaccccgtctctactaaaa

SEQ ID NO: 5829 - DNA, 20 bp, Artificial Sequence
  Description of Artificial Sequence: Synthetic oligonucleotide
aaccccgtctctactaaaaa

SEQ ID NO: 5830 - DNA, 20 bp, Artificial Sequence
  Description of Artificial Sequence: Synthetic oligonucleotide
accccgtctctactaaaaat

SEQ ID NO: 5831 - DNA, 20 bp, Artificial Sequence
  Description of Artificial Sequence: Synthetic oligonucleotide
ccccgtctctactaaaaata

SEQ ID NO: 5832 - DNA, 20 bp, Artificial Sequence
  Description of Artificial Sequence: Synthetic oligonucleotide
cccgtctctactaaaaatac

SEQ ID NO: 5833 - DNA, 20 bp, Artificial Sequence
  Description of Artificial Sequence: Synthetic oligonucleotide
ccgtctctactaaaaataca

SEQ ID NO: 5834 - DNA, 20 bp, Artificial Sequence
  Description of Artificial Sequence: Synthetic oligonucleotide
cgtctctactaaaaatacaa

SEQ ID NO: 5835 - DNA, 20 bp, Artificial Sequence
  Description of Artificial Sequence: Synthetic oligonucleotide
gtctctactaaaaatacaaa

SEQ ID NO: 5836 - DNA, 20 bp, Artificial Sequence
  Description of Artificial Sequence: Synthetic oligonucleotide
tctctactaaaaatacaaaa

SEQ ID NO: 5837 - DNA, 20 bp, Artificial Sequence
  Description of Artificial Sequence: Synthetic oligonucleotide
ctctactaaaaatacaaaac

SEQ ID NO: 5838 - DNA, 20 bp, Artificial Sequence
  Description of Artificial Sequence: Synthetic oligonucleotide
tctactaaaaatacaaaaca

SEQ ID NO: 5839 - DNA, 20 bp, Artificial Sequence
  Description of Artificial Sequence: Synthetic oligonucleotide
ctactaaaaatacaaaacaa

SEQ ID NO: 5840 - DNA, 20 bp, Artificial Sequence
  Description of Artificial Sequence: Synthetic oligonucleotide
tactaaaaatacaaaacaat

SEQ ID NO: 5841 - DNA, 20 bp, Artificial Sequence
  Description of Artificial Sequence: Synthetic oligonucleotide
actaaaaatacaaaacaatt

SEQ ID NO: 5842 - DNA, 20 bp, Artificial Sequence
  Description of Artificial Sequence: Synthetic oligonucleotide
ctaaaaatacaaaacaatta

SEQ ID NO: 5843 - DNA, 20 bp, Artificial Sequence
  Description of Artificial Sequence: Synthetic oligonucleotide
taaaaatacaaaacaattat

SEQ ID NO: 5844 - DNA, 20 bp, Artificial Sequence
  Description of Artificial Sequence: Synthetic oligonucleotide
aaaaatacaaaacaattatc

SEQ ID NO: 5845 - DNA, 20 bp, Artificial Sequence
  Description of Artificial Sequence: Synthetic oligonucleotide
aaaatacaaaacaattatct

SEQ ID NO: 5846 - DNA, 20 bp, Artificial Sequence
  Description of Artificial Sequence: Synthetic oligonucleotide
aaatacaaaacaattatctg

SEQ ID NO: 5847 - DNA, 20 bp, Artificial Sequence
  Description of Artificial Sequence: Synthetic oligonucleotide
aatacaaaacaattatctgt

SEQ ID NO: 5848 - DNA, 20 bp, Artificial Sequence
  Description of Artificial Sequence: Synthetic oligonucleotide
atacaaaacaattatctgtg

SEQ ID NO: 5849 - DNA, 20 bp, Artificial Sequence
  Description of Artificial Sequence: Synthetic oligonucleotide
tacaaaacaattatctgtgc

SEQ ID NO: 5850 - DNA, 20 bp, Artificial Sequence
  Description of Artificial Sequence: Synthetic oligonucleotide
acaaaacaattatctgtgca

SEQ ID NO: 5851 - DNA, 20 bp, Artificial Sequence
  Description of Artificial Sequence: Synthetic oligonucleotide
caaaacaattatctgtgcat

SEQ ID NO: 5852 - DNA, 20 bp, Artificial Sequence
  Description of Artificial Sequence: Synthetic oligonucleotide
aaaacaattatctgtgcatg

SEQ ID NO: 5853 - DNA, 20 bp, Artificial Sequence
  Description of Artificial Sequence: Synthetic oligonucleotide
aaacaattatctgtgcatgg

SEQ ID NO: 5854 - DNA, 20 bp, Artificial Sequence
  Description of Artificial Sequence: Synthetic oligonucleotide
aacaattatctgtgcatggt

SEQ ID NO: 5855 - DNA, 20 bp, Artificial Sequence
  Description of Artificial Sequence: Synthetic oligonucleotide
acaattatctgtgcatggtg

SEQ ID NO: 5856 - DNA, 20 bp, Artificial Sequence
  Description of Artificial Sequence: Synthetic oligonucleotide
caattatctgtgcatggtgg

SEQ ID NO: 5857 - DNA, 20 bp, Artificial Sequence
  Description of Artificial Sequence: Synthetic oligonucleotide
aattatctgtgcatggtggc

SEQ ID NO: 5858 - DNA, 20 bp, Artificial Sequence
  Description of Artificial Sequence: Synthetic oligonucleotide
attatctgtgcatggtggcg

SEQ ID NO: 5859 - DNA, 20 bp, Artificial Sequence
  Description of Artificial Sequence: Synthetic oligonucleotide
ttatctgtgcatggtggcgg

SEQ ID NO: 5860 - DNA, 20 bp, Artificial Sequence
  Description of Artificial Sequence: Synthetic oligonucleotide
tatctgtgcatggtggcggg

SEQ ID NO: 5861 - DNA, 20 bp, Artificial Sequence
  Description of Artificial Sequence: Synthetic oligonucleotide
atctgtgcatggtggcggga

SEQ ID NO: 5862 - DNA, 20 bp, Artificial Sequence
  Description of Artificial Sequence: Synthetic oligonucleotide
tctgtgcatggtggcgggaa

SEQ ID NO: 5863 - DNA, 20 bp, Artificial Sequence
  Description of Artificial Sequence: Synthetic oligonucleotide
ctgtgcatggtggcgggaac

SEQ ID NO: 5864 - DNA, 20 bp, Artificial Sequence
  Description of Artificial Sequence: Synthetic oligonucleotide
tgtgcatggtggcgggaacc

SEQ ID NO: 5865 - DNA, 20 bp, Artificial Sequence
  Description of Artificial Sequence: Synthetic oligonucleotide
gtgcatggtggcgggaacct

SEQ ID NO: 5866 - DNA, 20 bp, Artificial Sequence
  Description of Artificial Sequence: Synthetic oligonucleotide
tgcatggtggcgggaacctg

SEQ ID NO: 5867 - DNA, 20 bp, Artificial Sequence
  Description of Artificial Sequence: Synthetic oligonucleotide
gcatggtggcgggaacctgt

SEQ ID NO: 5868 - DNA, 20 bp, Artificial Sequence
  Description of Artificial Sequence: Synthetic oligonucleotide
catggtggcgggaacctgta

SEQ ID NO: 5869 - DNA, 20 bp, Artificial Sequence
  Description of Artificial Sequence: Synthetic oligonucleotide
atggtggcgggaacctgtaa

SEQ ID NO: 5870 - DNA, 20 bp, Artificial Sequence
  Description of Artificial Sequence: Synthetic oligonucleotide
tggtggcgggaacctgtaat

SEQ ID NO: 5871 - DNA, 20 bp, Artificial Sequence
  Description of Artificial Sequence: Synthetic oligonucleotide
ggtggcgggaacctgtaatc

SEQ ID NO: 5872 - DNA, 20 bp, Artificial Sequence
  Description of Artificial Sequence: Synthetic oligonucleotide
gtggcgggaacctgtaatcc

SEQ ID NO: 5873 - DNA, 20 bp, Artificial Sequence
  Description of Artificial Sequence: Synthetic oligonucleotide
tggcgggaacctgtaatccc

SEQ ID NO: 5874 - DNA, 20 bp, Artificial Sequence
  Description of Artificial Sequence: Synthetic oligonucleotide
ggcgggaacctgtaatccca

SEQ ID NO: 5875 - DNA, 20 bp, Artificial Sequence
  Description of Artificial Sequence: Synthetic oligonucleotide
gcgggaacctgtaatcccag

SEQ ID NO: 5876 - DNA, 20 bp, Artificial Sequence
  Description of Artificial Sequence: Synthetic oligonucleotide
cgggaacctgtaatcccagc

SEQ ID NO: 5877 - DNA, 20 bp, Artificial Sequence
  Description of Artificial Sequence: Synthetic oligonucleotide
gggaacctgtaatcccagct

SEQ ID NO: 5878 - DNA, 20 bp, Artificial Sequence
  Description of Artificial Sequence: Synthetic oligonucleotide
ggaacctgtaatcccagcta

SEQ ID NO: 5879 - DNA, 20 bp, Artificial Sequence
  Description of Artificial Sequence: Synthetic oligonucleotide
gaacctgtaatcccagctac

SEQ ID NO: 5880 - DNA, 20 bp, Artificial Sequence
  Description of Artificial Sequence: Synthetic oligonucleotide
aacctgtaatcccagctact

SEQ ID NO: 5881 - DNA, 20 bp, Artificial Sequence
  Description of Artificial Sequence: Synthetic oligonucleotide
acctgtaatcccagctactc

SEQ ID NO: 5882 - DNA, 20 bp, Artificial Sequence
  Description of Artificial Sequence: Synthetic oligonucleotide
cctgtaatcccagctactca

SEQ ID NO: 5883 - DNA, 20 bp, Artificial Sequence
  Description of Artificial Sequence: Synthetic oligonucleotide
ctgtaatcccagctactcag

SEQ ID NO: 5884 - DNA, 20 bp, Artificial Sequence
  Description of Artificial Sequence: Synthetic oligonucleotide
tgtaatcccagctactcagg

SEQ ID NO: 5885 - DNA, 20 bp, Artificial Sequence
  Description of Artificial Sequence: Synthetic oligonucleotide
gtaatcccagctactcagga

SEQ ID NO: 5886 - DNA, 20 bp, Artificial Sequence
  Description of Artificial Sequence: Synthetic oligonucleotide
taatcccagctactcaggag

SEQ ID NO: 5887 - DNA, 20 bp, Artificial Sequence
  Description of Artificial Sequence: Synthetic oligonucleotide
aatcccagctactcaggagg

SEQ ID NO: 5888 - DNA, 20 bp, Artificial Sequence
  Description of Artificial Sequence: Synthetic oligonucleotide
atcccagctactcaggaggc

SEQ ID NO: 5889 - DNA, 20 bp, Artificial Sequence
  Description of Artificial Sequence: Synthetic oligonucleotide
tcccagctactcaggaggct

SEQ ID NO: 5890 - DNA, 20 bp, Artificial Sequence
  Description of Artificial Sequence: Synthetic oligonucleotide
cccagctactcaggaggctg

SEQ ID NO: 5891 - DNA, 20 bp, Artificial Sequence
  Description of Artificial Sequence: Synthetic oligonucleotide
ccagctactcaggaggctga

SEQ ID NO: 5892 - DNA, 20 bp, Artificial Sequence
  Description of Artificial Sequence: Synthetic oligonucleotide
cagctactcaggaggctgag

SEQ ID NO: 5893 - DNA, 20 bp, Artificial Sequence
  Description of Artificial Sequence: Synthetic oligonucleotide
agctactcaggaggctgagg

SEQ ID NO: 5894 - DNA, 20 bp, Artificial Sequence
  Description of Artificial Sequence: Synthetic oligonucleotide
gctactcaggaggctgaggc

SEQ ID NO: 5895 - DNA, 20 bp, Artificial Sequence
  Description of Artificial Sequence: Synthetic oligonucleotide
ctactcaggaggctgaggca

SEQ ID NO: 5896 - DNA, 20 bp, Artificial Sequence
  Description of Artificial Sequence: Synthetic oligonucleotide
tactcaggaggctgaggcag

SEQ ID NO: 5897 - DNA, 20 bp, Artificial Sequence
  Description of Artificial Sequence: Synthetic oligonucleotide
actcaggaggctgaggcagg

SEQ ID NO: 5898 - DNA, 20 bp, Artificial Sequence
  Description of Artificial Sequence: Synthetic oligonucleotide
ctcaggaggctgaggcagga

SEQ ID NO: 5899 - DNA, 20 bp, Artificial Sequence
  Description of Artificial Sequence: Synthetic oligonucleotide
tcaggaggctgaggcaggag

SEQ ID NO: 5900 - DNA, 20 bp, Artificial Sequence
  Description of Artificial Sequence: Synthetic oligonucleotide
caggaggctgaggcaggaga

SEQ ID NO: 5901 - DNA, 20 bp, Artificial Sequence
  Description of Artificial Sequence: Synthetic oligonucleotide
aggaggctgaggcaggagaa

SEQ ID NO: 5902 - DNA, 20 bp, Artificial Sequence
  Description of Artificial Sequence: Synthetic oligonucleotide
ggaggctgaggcaggagaat

SEQ ID NO: 5903 - DNA, 20 bp, Artificial Sequence
  Description of Artificial Sequence: Synthetic oligonucleotide
gaggctgaggcaggagaatc

SEQ ID NO: 5904 - DNA, 20 bp, Artificial Sequence
  Description of Artificial Sequence: Synthetic oligonucleotide
aggctgaggcaggagaatca

SEQ ID NO: 5905 - DNA, 20 bp, Artificial Sequence
  Description of Artificial Sequence: Synthetic oligonucleotide
ggctgaggcaggagaatcac

SEQ ID NO: 5906 - DNA, 20 bp, Artificial Sequence
  Description of Artificial Sequence: Synthetic oligonucleotide
gctgaggcaggagaatcact

SEQ ID NO: 5907 - DNA, 20 bp, Artificial Sequence
  Description of Artificial Sequence: Synthetic oligonucleotide
ctgaggcaggagaatcactt

SEQ ID NO: 5908 - DNA, 20 bp, Artificial Sequence
  Description of Artificial Sequence: Synthetic oligonucleotide
tgaggcaggagaatcacttg

SEQ ID NO: 5909 - DNA, 20 bp, Artificial Sequence
  Description of Artificial Sequence: Synthetic oligonucleotide
gaggcaggagaatcacttga

SEQ ID NO: 5910 - DNA, 20 bp, Artificial Sequence
  Description of Artificial Sequence: Synthetic oligonucleotide
aggcaggagaatcacttgaa

SEQ ID NO: 5911 - DNA, 20 bp, Artificial Sequence
  Description of Artificial Sequence: Synthetic oligonucleotide
ggcaggagaatcacttgaac

SEQ ID NO: 5912 - DNA, 20 bp, Artificial Sequence
  Description of Artificial Sequence: Synthetic oligonucleotide
gcaggagaatcacttgaacc

SEQ ID NO: 5913 - DNA, 20 bp, Artificial Sequence
  Description of Artificial Sequence: Synthetic oligonucleotide
caggagaatcacttgaaccc

SEQ ID NO: 5914 - DNA, 20 bp, Artificial Sequence
  Description of Artificial Sequence: Synthetic oligonucleotide
aggagaatcacttgaaccca

SEQ ID NO: 5915 - DNA, 20 bp, Artificial Sequence
  Description of Artificial Sequence: Synthetic oligonucleotide
ggagaatcacttgaacccag

SEQ ID NO: 5916 - DNA, 20 bp, Artificial Sequence
  Description of Artificial Sequence: Synthetic oligonucleotide
gagaatcacttgaacccagg

SEQ ID NO: 5917 - DNA, 20 bp, Artificial Sequence
  Description of Artificial Sequence: Synthetic oligonucleotide
agaatcacttgaacccagga

SEQ ID NO: 5918 - DNA, 20 bp, Artificial Sequence
  Description of Artificial Sequence: Synthetic oligonucleotide
gaatcacttgaacccaggag

SEQ ID NO: 5919 - DNA, 20 bp, Artificial Sequence
  Description of Artificial Sequence: Synthetic oligonucleotide
aatcacttgaacccaggagg

SEQ ID NO: 5920 - DNA, 20 bp, Artificial Sequence
  Description of Artificial Sequence: Synthetic oligonucleotide
atcacttgaacccaggaggc

SEQ ID NO: 5921 - DNA, 20 bp, Artificial Sequence
  Description of Artificial Sequence: Synthetic oligonucleotide
tcacttgaacccaggaggcg

SEQ ID NO: 5922 - DNA, 20 bp, Artificial Sequence
  Description of Artificial Sequence: Synthetic oligonucleotide
cacttgaacccaggaggcgg

SEQ ID NO: 5923 - DNA, 20 bp, Artificial Sequence
  Description of Artificial Sequence: Synthetic oligonucleotide
acttgaacccaggaggcgga

SEQ ID NO: 5924 - DNA, 20 bp, Artificial Sequence
  Description of Artificial Sequence: Synthetic oligonucleotide
cttgaacccaggaggcggag

SEQ ID NO: 5925 - DNA, 20 bp, Artificial Sequence
  Description of Artificial Sequence: Synthetic oligonucleotide
ttgaacccaggaggcggagg

SEQ ID NO: 5926 - DNA, 20 bp, Artificial Sequence
  Description of Artificial Sequence: Synthetic oligonucleotide
tgaacccaggaggcggaggc

SEQ ID NO: 5927 - DNA, 20 bp, Artificial Sequence
  Description of Artificial Sequence: Synthetic oligonucleotide
gaacccaggaggcggaggct

SEQ ID NO: 5928 - DNA, 20 bp, Artificial Sequence
  Description of Artificial Sequence: Synthetic oligonucleotide
aacccaggaggcggaggctg

SEQ ID NO: 5929 - DNA, 20 bp, Artificial Sequence
  Description of Artificial Sequence: Synthetic oligonucleotide
acccaggaggcggaggctgc

SEQ ID NO: 5930 - DNA, 20 bp, Artificial Sequence
  Description of Artificial Sequence: Synthetic oligonucleotide
cccaggaggcggaggctgca

SEQ ID NO: 5931 - DNA, 20 bp, Artificial Sequence
  Description of Artificial Sequence: Synthetic oligonucleotide
ccaggaggcggaggctgcag

SEQ ID NO: 5932 - DNA, 20 bp, Artificial Sequence
  Description of Artificial Sequence: Synthetic oligonucleotide
caggaggcggaggctgcagt

SEQ ID NO: 5933 - DNA, 20 bp, Artificial Sequence
  Description of Artificial Sequence: Synthetic oligonucleotide
aggaggcggaggctgcagtg

SEQ ID NO: 5934 - DNA, 20 bp, Artificial Sequence
  Description of Artificial Sequence: Synthetic oligonucleotide
ggaggcggaggctgcagtga

SEQ ID NO: 5935 - DNA, 20 bp, Artificial Sequence
  Description of Artificial Sequence: Synthetic oligonucleotide
gaggcggaggctgcagtgag

SEQ ID NO: 5936 - DNA, 20 bp, Artificial Sequence
  Description of Artificial Sequence: Synthetic oligonucleotide
aggcggaggctgcagtgagc

SEQ ID NO: 5937 - DNA, 20 bp, Artificial Sequence
  Description of Artificial Sequence: Synthetic oligonucleotide
ggcggaggctgcagtgagcc

SEQ ID NO: 5938 - DNA, 20 bp, Artificial Sequence
  Description of Artificial Sequence: Synthetic oligonucleotide
gcggaggctgcagtgagcca

SEQ ID NO: 5939 - DNA, 20 bp, Artificial Sequence
  Description of Artificial Sequence: Synthetic oligonucleotide
cggaggctgcagtgagccaa

SEQ ID NO: 5940 - DNA, 20 bp, Artificial Sequence
  Description of Artificial Sequence: Synthetic oligonucleotide
ggaggctgcagtgagccaag

SEQ ID NO: 5941 - DNA, 20 bp, Artificial Sequence
  Description of Artificial Sequence: Synthetic oligonucleotide
gaggctgcagtgagccaaga

SEQ ID NO: 5942 - DNA, 20 bp, Artificial Sequence
  Description of Artificial Sequence: Synthetic oligonucleotide
aggctgcagtgagccaagat

SEQ ID NO: 5943 - DNA, 20 bp, Artificial Sequence
  Description of Artificial Sequence: Synthetic oligonucleotide
ggctgcagtgagccaagatc

SEQ ID NO: 5944 - DNA, 20 bp, Artificial Sequence
  Description of Artificial Sequence: Synthetic oligonucleotide
gctgcagtgagccaagatca

SEQ ID NO: 5945 - DNA, 20 bp, Artificial Sequence
  Description of Artificial Sequence: Synthetic oligonucleotide
ctgcagtgagccaagatcac

SEQ ID NO: 5946 - DNA, 20 bp, Artificial Sequence
  Description of Artificial Sequence: Synthetic oligonucleotide
tgcagtgagccaagatcacg

SEQ ID NO: 5947 - DNA, 20 bp, Artificial Sequence
  Description of Artificial Sequence: Synthetic oligonucleotide
gcagtgagccaagatcacgt

SEQ ID NO: 5948 - DNA, 20 bp, Artificial Sequence
  Description of Artificial Sequence: Synthetic oligonucleotide
cagtgagccaagatcacgtc

SEQ ID NO: 5949 - DNA, 20 bp, Artificial Sequence
  Description of Artificial Sequence: Synthetic oligonucleotide
agtgagccaagatcacgtca

SEQ ID NO: 5950 - DNA, 20 bp, Artificial Sequence
  Description of Artificial Sequence: Synthetic oligonucleotide
gtgagccaagatcacgtcac

SEQ ID NO: 5951 - DNA, 20 bp, Artificial Sequence
  Description of Artificial Sequence: Synthetic oligonucleotide
tgagccaagatcacgtcact

SEQ ID NO: 5952 - DNA, 20 bp, Artificial Sequence
  Description of Artificial Sequence: Synthetic oligonucleotide
gagccaagatcacgtcactt

SEQ ID NO: 5953 - DNA, 20 bp, Artificial Sequence
  Description of Artificial Sequence: Synthetic oligonucleotide
agccaagatcacgtcacttg

SEQ ID NO: 5954 - DNA, 20 bp, Artificial Sequence
  Description of Artificial Sequence: Synthetic oligonucleotide
gccaagatcacgtcacttgc

SEQ ID NO: 5955 - DNA, 20 bp, Artificial Sequence
  Description of Artificial Sequence: Synthetic oligonucleotide
ccaagatcacgtcacttgca

SEQ ID NO: 5956 - DNA, 20 bp, Artificial Sequence
  Description of Artificial Sequence: Synthetic oligonucleotide
caagatcacgtcacttgcac

SEQ ID NO: 5957 - DNA, 20 bp, Artificial Sequence
  Description of Artificial Sequence: Synthetic oligonucleotide
aagatcacgtcacttgcact

SEQ ID NO: 5958 - DNA, 20 bp, Artificial Sequence
  Description of Artificial Sequence: Synthetic oligonucleotide
agatcacgtcacttgcactc

SEQ ID NO: 5959 - DNA, 20 bp, Artificial Sequence
  Description of Artificial Sequence: Synthetic oligonucleotide
gatcacgtcacttgcactcc

SEQ ID NO: 5960 - DNA, 20 bp, Artificial Sequence
  Description of Artificial Sequence: Synthetic oligonucleotide
atcacgtcacttgcactcca

SEQ ID NO: 5961 - DNA, 20 bp, Artificial Sequence
  Description of Artificial Sequence: Synthetic oligonucleotide
tcacgtcacttgcactccag

SEQ ID NO: 5962 - DNA, 20 bp, Artificial Sequence
  Description of Artificial Sequence: Synthetic oligonucleotide
cacgtcacttgcactccagc

SEQ ID NO: 5963 - DNA, 20 bp, Artificial Sequence
  Description of Artificial Sequence: Synthetic oligonucleotide
acgtcacttgcactccagcc

SEQ ID NO: 5964 - DNA, 20 bp, Artificial Sequence
  Description of Artificial Sequence: Synthetic oligonucleotide
cgtcacttgcactccagcct

SEQ ID NO: 5965 - DNA, 20 bp, Artificial Sequence
  Description of Artificial Sequence: Synthetic oligonucleotide
gtcacttgcactccagcctg

SEQ ID NO: 5966 - DNA, 20 bp, Artificial Sequence
  Description of Artificial Sequence: Synthetic oligonucleotide
tcacttgcactccagcctgg

SEQ ID NO: 5967 - DNA, 20 bp, Artificial Sequence
  Description of Artificial Sequence: Synthetic oligonucleotide
cacttgcactccagcctggg

SEQ ID NO: 5968 - DNA, 20 bp, Artificial Sequence
  Description of Artificial Sequence: Synthetic oligonucleotide
acttgcactccagcctggga

SEQ ID NO: 5969 - DNA, 20 bp, Artificial Sequence
  Description of Artificial Sequence: Synthetic oligonucleotide
cttgcactccagcctgggag

SEQ ID NO: 5970 - DNA, 20 bp, Artificial Sequence
  Description of Artificial Sequence: Synthetic oligonucleotide
ttgcactccagcctgggaga

SEQ ID NO: 5971 - DNA, 20 bp, Artificial Sequence
  Description of Artificial Sequence: Synthetic oligonucleotide
tgcactccagcctgggagac

SEQ ID NO: 5972 - DNA, 20 bp, Artificial Sequence
  Description of Artificial Sequence: Synthetic oligonucleotide
gcactccagcctgggagaca

SEQ ID NO: 5973 - DNA, 20 bp, Artificial Sequence
  Description of Artificial Sequence: Synthetic oligonucleotide
cactccagcctgggagacac

SEQ ID NO: 5974 - DNA, 20 bp, Artificial Sequence
  Description of Artificial Sequence: Synthetic oligonucleotide
actccagcctgggagacaca

SEQ ID NO: 5975 - DNA, 20 bp, Artificial Sequence
  Description of Artificial Sequence: Synthetic oligonucleotide
ctccagcctgggagacacag

SEQ ID NO: 5976 - DNA, 20 bp, Artificial Sequence
  Description of Artificial Sequence: Synthetic oligonucleotide
tccagcctgggagacacagc

SEQ ID NO: 5977 - DNA, 20 bp, Artificial Sequence
  Description of Artificial Sequence: Synthetic oligonucleotide
ccagcctgggagacacagcg

SEQ ID NO: 5978 - DNA, 20 bp, Artificial Sequence
  Description of Artificial Sequence: Synthetic oligonucleotide
cagcctgggagacacagcgg

SEQ ID NO: 5979 - DNA, 20 bp, Artificial Sequence
  Description of Artificial Sequence: Synthetic oligonucleotide
agcctgggagacacagcggg

SEQ ID NO: 5980 - DNA, 20 bp, Artificial Sequence
  Description of Artificial Sequence: Synthetic oligonucleotide
gcctgggagacacagcggga

SEQ ID NO: 5981 - DNA, 20 bp, Artificial Sequence
  Description of Artificial Sequence: Synthetic oligonucleotide
cctgggagacacagcgggac

SEQ ID NO: 5982 - DNA, 20 bp, Artificial Sequence
  Description of Artificial Sequence: Synthetic oligonucleotide
ctgggagacacagcgggact

SEQ ID NO: 5983 - DNA, 20 bp, Artificial Sequence
  Description of Artificial Sequence: Synthetic oligonucleotide
tgggagacacagcgggactc

SEQ ID NO: 5984 - DNA, 20 bp, Artificial Sequence
  Description of Artificial Sequence: Synthetic oligonucleotide
gggagacacagcgggactct

SEQ ID NO: 5985 - DNA, 20 bp, Artificial Sequence
  Description of Artificial Sequence: Synthetic oligonucleotide
ggagacacagcgggactctg

SEQ ID NO: 5986 - DNA, 20 bp, Artificial Sequence
  Description of Artificial Sequence: Synthetic oligonucleotide
gagacacagcgggactctgt

SEQ ID NO: 5987 - DNA, 20 bp, Artificial Sequence
  Description of Artificial Sequence: Synthetic oligonucleotide
agacacagcgggactctgtc

SEQ ID NO: 5988 - DNA, 20 bp, Artificial Sequence
  Description of Artificial Sequence: Synthetic oligonucleotide
gacacagcgggactctgtct

SEQ ID NO: 5989 - DNA, 20 bp, Artificial Sequence
  Description of Artificial Sequence: Synthetic oligonucleotide
acacagcgggactctgtctc

SEQ ID NO: 5990 - DNA, 20 bp, Artificial Sequence
  Description of Artificial Sequence: Synthetic oligonucleotide
cacagcgggactctgtctca

SEQ ID NO: 5991 - DNA, 20 bp, Artificial Sequence
  Description of Artificial Sequence: Synthetic oligonucleotide
acagcgggactctgtctcaa

SEQ ID NO: 5992 - DNA, 20 bp, Artificial Sequence
  Description of Artificial Sequence: Synthetic oligonucleotide
cagcgggactctgtctcaaa

SEQ ID NO: 5993 - DNA, 20 bp, Artificial Sequence
  Description of Artificial Sequence: Synthetic oligonucleotide
agcgggactctgtctcaaaa

SEQ ID NO: 5994 - DNA, 20 bp, Artificial Sequence
  Description of Artificial Sequence: Synthetic oligonucleotide
gcgggactctgtctcaaaaa

SEQ ID NO: 5995 - DNA, 20 bp, Artificial Sequence
  Description of Artificial Sequence: Synthetic oligonucleotide
cgggactctgtctcaaaaaa

SEQ ID NO: 5996 - DNA, 20 bp, Artificial Sequence
  Description of Artificial Sequence: Synthetic oligonucleotide
gggactctgtctcaaaaaat

SEQ ID NO: 5997 - DNA, 20 bp, Artificial Sequence
  Description of Artificial Sequence: Synthetic oligonucleotide
ggactctgtctcaaaaaata

SEQ ID NO: 5998 - DNA, 20 bp, Artificial Sequence
  Description of Artificial Sequence: Synthetic oligonucleotide
gactctgtctcaaaaaataa

SEQ ID NO: 5999 - DNA, 20 bp, Artificial Sequence
  Description of Artificial Sequence: Synthetic oligonucleotide
actctgtctcaaaaaataaa

SEQ ID NO: 6000 - DNA, 20 bp, Artificial Sequence
  Description of Artificial Sequence: Synthetic oligonucleotide
ctctgtctcaaaaaataaat

SEQ ID NO: 6001 - DNA, 20 bp, Artificial Sequence
  Description of Artificial Sequence: Synthetic oligonucleotide
tctgtctcaaaaaataaata

SEQ ID NO: 6002 - DNA, 20 bp, Artificial Sequence
  Description of Artificial Sequence: Synthetic oligonucleotide
ctgtctcaaaaaataaataa

SEQ ID NO: 6003 - DNA, 20 bp, Artificial Sequence
  Description of Artificial Sequence: Synthetic oligonucleotide
tgtctcaaaaaataaataag

SEQ ID NO: 6004 - DNA, 20 bp, Artificial Sequence
  Description of Artificial Sequence: Synthetic oligonucleotide
gtctcaaaaaataaataagt

SEQ ID NO: 6005 - DNA, 20 bp, Artificial Sequence
  Description of Artificial Sequence: Synthetic oligonucleotide
tctcaaaaaataaataagta

SEQ ID NO: 6006 - DNA, 20 bp, Artificial Sequence
  Description of Artificial Sequence: Synthetic oligonucleotide
ctcaaaaaataaataagtag

SEQ ID NO: 6007 - DNA, 20 bp, Artificial Sequence
  Description of Artificial Sequence: Synthetic oligonucleotide
tcaaaaaataaataagtagg

SEQ ID NO: 6008 - DNA, 20 bp, Artificial Sequence
  Description of Artificial Sequence: Synthetic oligonucleotide
caaaaaataaataagtaggc

SEQ ID NO: 6009 - DNA, 20 bp, Artificial Sequence
  Description of Artificial Sequence: Synthetic oligonucleotide
aaaaaataaataagtaggcc

SEQ ID NO: 6010 - DNA, 20 bp, Artificial Sequence
  Description of Artificial Sequence: Synthetic oligonucleotide
aaaaataaataagtaggccg

SEQ ID NO: 6011 - DNA, 20 bp, Artificial Sequence
  Description of Artificial Sequence: Synthetic oligonucleotide
aaaataaataagtaggccgg

SEQ ID NO: 6012 - DNA, 20 bp, Artificial Sequence
  Description of Artificial Sequence: Synthetic oligonucleotide
aaataaataagtaggccggg

SEQ ID NO: 6013 - DNA, 20 bp, Artificial Sequence
  Description of Artificial Sequence: Synthetic oligonucleotide
aataaataagtaggccgggc

SEQ ID NO: 6014 - DNA, 20 bp, Artificial Sequence
  Description of Artificial Sequence: Synthetic oligonucleotide
ataaataagtaggccgggcg

SEQ ID NO: 6015 - DNA, 20 bp, Artificial Sequence
  Description of Artificial Sequence: Synthetic oligonucleotide
taaataagtaggccgggcgc

SEQ ID NO: 6016 - DNA, 20 bp, Artificial Sequence
  Description of Artificial Sequence: Synthetic oligonucleotide
aaataagtaggccgggcgcg

SEQ ID NO: 6017 - DNA, 20 bp, Artificial Sequence
  Description of Artificial Sequence: Synthetic oligonucleotide
aataagtaggccgggcgcgg

SEQ ID NO: 6018 - DNA, 20 bp, Artificial Sequence
  Description of Artificial Sequence: Synthetic oligonucleotide
ataagtaggccgggcgcggt

SEQ ID NO: 6019 - DNA, 20 bp, Artificial Sequence
  Description of Artificial Sequence: Synthetic oligonucleotide
taagtaggccgggcgcggtg

SEQ ID NO: 6020 - DNA, 20 bp, Artificial Sequence
  Description of Artificial Sequence: Synthetic oligonucleotide
aagtaggccgggcgcggtgg

SEQ ID NO: 6021 - DNA, 20 bp, Artificial Sequence
  Description of Artificial Sequence: Synthetic oligonucleotide
agtaggccgggcgcggtggc

SEQ ID NO: 6022 - DNA, 20 bp, Artificial Sequence
  Description of Artificial Sequence: Synthetic oligonucleotide
gtaggccgggcgcggtggct

SEQ ID NO: 6023 - DNA, 20 bp, Artificial Sequence
  Description of Artificial Sequence: Synthetic oligonucleotide
taggccgggcgcggtggctc

SEQ ID NO: 6024 - DNA, 20 bp, Artificial Sequence
  Description of Artificial Sequence: Synthetic oligonucleotide
aggccgggcgcggtggctca

SEQ ID NO: 6025 - DNA, 20 bp, Artificial Sequence
  Description of Artificial Sequence: Synthetic oligonucleotide
ggccgggcgcggtggctcac

SEQ ID NO: 6026 - DNA, 20 bp, Artificial Sequence
  Description of Artificial Sequence: Synthetic oligonucleotide
gccgggcgcggtggctcacg

SEQ ID NO: 6027 - DNA, 20 bp, Artificial Sequence
  Description of Artificial Sequence: Synthetic oligonucleotide
ccgggcgcggtggctcacgc

SEQ ID NO: 6028 - DNA, 20 bp, Artificial Sequence
  Description of Artificial Sequence: Synthetic oligonucleotide
cgggcgcggtggctcacgcc

SEQ ID NO: 6029 - DNA, 20 bp, Artificial Sequence
  Description of Artificial Sequence: Synthetic oligonucleotide
gggcgcggtggctcacgcct

SEQ ID NO: 6030 - DNA, 20 bp, Artificial Sequence
  Description of Artificial Sequence: Synthetic oligonucleotide
ggcgcggtggctcacgcctg

SEQ ID NO: 6031 - DNA, 20 bp, Artificial Sequence
  Description of Artificial Sequence: Synthetic oligonucleotide
gcgcggtggctcacgcctgt

SEQ ID NO: 6032 - DNA, 20 bp, Artificial Sequence
  Description of Artificial Sequence: Synthetic oligonucleotide
cgcggtggctcacgcctgta

SEQ ID NO: 6033 - DNA, 20 bp, Artificial Sequence
  Description of Artificial Sequence: Synthetic oligonucleotide
gcggtggctcacgcctgtaa

SEQ ID NO: 6034 - DNA, 20 bp, Artificial Sequence
  Description of Artificial Sequence: Synthetic oligonucleotide
cggtggctcacgcctgtaat

SEQ ID NO: 6035 - DNA, 20 bp, Artificial Sequence
  Description of Artificial Sequence: Synthetic oligonucleotide
ggtggctcacgcctgtaatc

SEQ ID NO: 6036 - DNA, 20 bp, Artificial Sequence
  Description of Artificial Sequence: Synthetic oligonucleotide
gtggctcacgcctgtaatcc

SEQ ID NO: 6037 - DNA, 20 bp, Artificial Sequence
  Description of Artificial Sequence: Synthetic oligonucleotide
tggctcacgcctgtaatccc

SEQ ID NO: 6038 - DNA, 20 bp, Artificial Sequence
  Description of Artificial Sequence: Synthetic oligonucleotide
ggctcacgcctgtaatccca

SEQ ID NO: 6039 - DNA, 20 bp, Artificial Sequence
  Description of Artificial Sequence: Synthetic oligonucleotide
gctcacgcctgtaatcccag

SEQ ID NO: 6040 - DNA, 20 bp, Artificial Sequence
  Description of Artificial Sequence: Synthetic oligonucleotide
ctcacgcctgtaatcccagc

SEQ ID NO: 6041 - DNA, 20 bp, Artificial Sequence
  Description of Artificial Sequence: Synthetic oligonucleotide
tcacgcctgtaatcccagca

SEQ ID NO: 6042 - DNA, 20 bp, Artificial Sequence
  Description of Artificial Sequence: Synthetic oligonucleotide
cacgcctgtaatcccagcac

SEQ ID NO: 6043 - DNA, 20 bp, Artificial Sequence
  Description of Artificial Sequence: Synthetic oligonucleotide
acgcctgtaatcccagcact

SEQ ID NO: 6044 - DNA, 20 bp, Artificial Sequence
  Description of Artificial Sequence: Synthetic oligonucleotide
cgcctgtaatcccagcactt

SEQ ID NO: 6045 - DNA, 20 bp, Artificial Sequence
  Description of Artificial Sequence: Synthetic oligonucleotide
gcctgtaatcccagcacttt

SEQ ID NO: 6046 - DNA, 20 bp, Artificial Sequence
  Description of Artificial Sequence: Synthetic oligonucleotide
cctgtaatcccagcactttg

SEQ ID NO: 6047 - DNA, 20 bp, Artificial Sequence
  Description of Artificial Sequence: Synthetic oligonucleotide
ctgtaatcccagcactttgg

SEQ ID NO: 6048 - DNA, 20 bp, Artificial Sequence
  Description of Artificial Sequence: Synthetic oligonucleotide
tgtaatcccagcactttggg

SEQ ID NO: 6049 - DNA, 20 bp, Artificial Sequence
  Description of Artificial Sequence: Synthetic oligonucleotide
gtaatcccagcactttggga

SEQ ID NO: 6050 - DNA, 20 bp, Artificial Sequence
  Description of Artificial Sequence: Synthetic oligonucleotide
taatcccagcactttgggag

SEQ ID NO: 6051 - DNA, 20 bp, Artificial Sequence
  Description of Artificial Sequence: Synthetic oligonucleotide
aatcccagcactttgggagg

SEQ ID NO: 6052 - DNA, 20 bp, Artificial Sequence
  Description of Artificial Sequence: Synthetic oligonucleotide
atcccagcactttgggaggc

SEQ ID NO: 6053 - DNA, 20 bp, Artificial Sequence
  Description of Artificial Sequence: Synthetic oligonucleotide
tcccagcactttgggaggct

SEQ ID NO: 6054 - DNA, 20 bp, Artificial Sequence
  Description of Artificial Sequence: Synthetic oligonucleotide
cccagcactttgggaggctg

SEQ ID NO: 6055 - DNA, 20 bp, Artificial Sequence
  Description of Artificial Sequence: Synthetic oligonucleotide
ccagcactttgggaggctga

SEQ ID NO: 6056 - DNA, 20 bp, Artificial Sequence
  Description of Artificial Sequence: Synthetic oligonucleotide
cagcactttgggaggctgag

SEQ ID NO: 6057 - DNA, 20 bp, Artificial Sequence
  Description of Artificial Sequence: Synthetic oligonucleotide
agcactttgggaggctgagg

SEQ ID NO: 6058 - DNA, 20 bp, Artificial Sequence
  Description of Artificial Sequence: Synthetic oligonucleotide
gcactttgggaggctgaggc

SEQ ID NO: 6059 - DNA, 20 bp, Artificial Sequence
  Description of Artificial Sequence: Synthetic oligonucleotide
cactttgggaggctgaggca

SEQ ID NO: 6060 - DNA, 20 bp, Artificial Sequence
  Description of Artificial Sequence: Synthetic oligonucleotide
actttgggaggctgaggcag

SEQ ID NO: 6061 - DNA, 20 bp, Artificial Sequence
  Description of Artificial Sequence: Synthetic oligonucleotide
ctttgggaggctgaggcagg

SEQ ID NO: 6062 - DNA, 20 bp, Artificial Sequence
  Description of Artificial Sequence: Synthetic oligonucleotide
tttgggaggctgaggcaggc

SEQ ID NO: 6063 - DNA, 20 bp, Artificial Sequence
  Description of Artificial Sequence: Synthetic oligonucleotide
ttgggaggctgaggcaggca

SEQ ID NO: 6064 - DNA, 20 bp, Artificial Sequence
  Description of Artificial Sequence: Synthetic oligonucleotide
tgggaggctgaggcaggcag

SEQ ID NO: 6065 - DNA, 20 bp, Artificial Sequence
  Description of Artificial Sequence: Synthetic oligonucleotide
gggaggctgaggcaggcaga

SEQ ID NO: 6066 - DNA, 20 bp, Artificial Sequence
  Description of Artificial Sequence: Synthetic oligonucleotide
ggaggctgaggcaggcagat

SEQ ID NO: 6067 - DNA, 20 bp, Artificial Sequence
  Description of Artificial Sequence: Synthetic oligonucleotide
gaggctgaggcaggcagatc

SEQ ID NO: 6068 - DNA, 20 bp, Artificial Sequence
  Description of Artificial Sequence: Synthetic oligonucleotide
aggctgaggcaggcagatca

SEQ ID NO: 6069 - DNA, 20 bp, Artificial Sequence
  Description of Artificial Sequence: Synthetic oligonucleotide
ggctgaggcaggcagatcac

SEQ ID NO: 6070 - DNA, 20 bp, Artificial Sequence
  Description of Artificial Sequence: Synthetic oligonucleotide
gctgaggcaggcagatcacg

SEQ ID NO: 6071 - DNA, 20 bp, Artificial Sequence
  Description of Artificial Sequence: Synthetic oligonucleotide
ctgaggcaggcagatcacga

SEQ ID NO: 6072 - DNA, 20 bp, Artificial Sequence
  Description of Artificial Sequence: Synthetic oligonucleotide
tgaggcaggcagatcacgag

SEQ ID NO: 6073 - DNA, 20 bp, Artificial Sequence
  Description of Artificial Sequence: Synthetic oligonucleotide
gaggcaggcagatcacgagg

SEQ ID NO: 6074 - DNA, 20 bp, Artificial Sequence
  Description of Artificial Sequence: Synthetic oligonucleotide
aggcaggcagatcacgaggt

SEQ ID NO: 6075 - DNA, 20 bp, Artificial Sequence
  Description of Artificial Sequence: Synthetic oligonucleotide
ggcaggcagatcacgaggtc

SEQ ID NO: 6076 - DNA, 20 bp, Artificial Sequence
  Description of Artificial Sequence: Synthetic oligonucleotide
gcaggcagatcacgaggtca

SEQ ID NO: 6077 - DNA, 20 bp, Artificial Sequence
  Description of Artificial Sequence: Synthetic oligonucleotide
caggcagatcacgaggtcag

SEQ ID NO: 6078 - DNA, 20 bp, Artificial Sequence
  Description of Artificial Sequence: Synthetic oligonucleotide
aggcagatcacgaggtcagg

SEQ ID NO: 6079 - DNA, 20 bp, Artificial Sequence
  Description of Artificial Sequence: Synthetic oligonucleotide
ggcagatcacgaggtcagga

SEQ ID NO: 6080 - DNA, 20 bp, Artificial Sequence
  Description of Artificial Sequence: Synthetic oligonucleotide
gcagatcacgaggtcaggag

SEQ ID NO: 6081 - DNA, 20 bp, Artificial Sequence
  Description of Artificial Sequence: Synthetic oligonucleotide
cagatcacgaggtcaggaga

SEQ ID NO: 6082 - DNA, 20 bp, Artificial Sequence
  Description of Artificial Sequence: Synthetic oligonucleotide
agatcacgaggtcaggagat

SEQ ID NO: 6083 - DNA, 20 bp, Artificial Sequence
  Description of Artificial Sequence: Synthetic oligonucleotide
gatcacgaggtcaggagatc

SEQ ID NO: 6084 - DNA, 20 bp, Artificial Sequence
  Description of Artificial Sequence: Synthetic oligonucleotide
atcacgaggtcaggagatcg

SEQ ID NO: 6085 - DNA, 20 bp, Artificial Sequence
  Description of Artificial Sequence: Synthetic oligonucleotide
tcacgaggtcaggagatcga

SEQ ID NO: 6086 - DNA, 20 bp, Artificial Sequence
  Description of Artificial Sequence: Synthetic oligonucleotide
cacgaggtcaggagatcgag

SEQ ID NO: 6087 - DNA, 20 bp, Artificial Sequence
  Description of Artificial Sequence: Synthetic oligonucleotide
acgaggtcaggagatcgaga

SEQ ID NO: 6088 - DNA, 20 bp, Artificial Sequence
  Description of Artificial Sequence: Synthetic oligonucleotide
cgaggtcaggagatcgagac

SEQ ID NO: 6089 - DNA, 20 bp, Artificial Sequence
  Description of Artificial Sequence: Synthetic oligonucleotide
gaggtcaggagatcgagacc

SEQ ID NO: 6090 - DNA, 20 bp, Artificial Sequence
  Description of Artificial Sequence: Synthetic oligonucleotide
aggtcaggagatcgagacca

SEQ ID NO: 6091 - DNA, 20 bp, Artificial Sequence
  Description of Artificial Sequence: Synthetic oligonucleotide
ggtcaggagatcgagaccat

SEQ ID NO: 6092 - DNA, 20 bp, Artificial Sequence
  Description of Artificial Sequence: Synthetic oligonucleotide
gtcaggagatcgagaccatc

SEQ ID NO: 6093 - DNA, 20 bp, Artificial Sequence
  Description of Artificial Sequence: Synthetic oligonucleotide
tcaggagatcgagaccatcc

SEQ ID NO: 6094 - DNA, 20 bp, Artificial Sequence
  Description of Artificial Sequence: Synthetic oligonucleotide
caggagatcgagaccatcct

SEQ ID NO: 6095 - DNA, 20 bp, Artificial Sequence
  Description of Artificial Sequence: Synthetic oligonucleotide
aggagatcgagaccatcctg

SEQ ID NO: 6096 - DNA, 20 bp, Artificial Sequence
  Description of Artificial Sequence: Synthetic oligonucleotide
ggagatcgagaccatcctgg

SEQ ID NO: 6097 - DNA, 20 bp, Artificial Sequence
  Description of Artificial Sequence: Synthetic oligonucleotide
gagatcgagaccatcctggc

SEQ ID NO: 6098 - DNA, 20 bp, Artificial Sequence
  Description of Artificial Sequence: Synthetic oligonucleotide
agatcgagaccatcctggct

SEQ ID NO: 6099 - DNA, 20 bp, Artificial Sequence
  Description of Artificial Sequence: Synthetic oligonucleotide
gatcgagaccatcctggcta

SEQ ID NO: 6100 - DNA, 20 bp, Artificial Sequence
  Description of Artificial Sequence: Synthetic oligonucleotide
atcgagaccatcctggctaa

SEQ ID NO: 6101 - DNA, 20 bp, Artificial Sequence
  Description of Artificial Sequence: Synthetic oligonucleotide
tcgagaccatcctggctaac

SEQ ID NO: 6102 - DNA, 20 bp, Artificial Sequence
  Description of Artificial Sequence: Synthetic oligonucleotide
cgagaccatcctggctaaca

SEQ ID NO: 6103 - DNA, 20 bp, Artificial Sequence
  Description of Artificial Sequence: Synthetic oligonucleotide
gagaccatcctggctaacac

SEQ ID NO: 6104 - DNA, 20 bp, Artificial Sequence
  Description of Artificial Sequence: Synthetic oligonucleotide
agaccatcctggctaacacg

SEQ ID NO: 6105 - DNA, 20 bp, Artificial Sequence
  Description of Artificial Sequence: Synthetic oligonucleotide
gaccatcctggctaacacgg

SEQ ID NO: 6106 - DNA, 20 bp, Artificial Sequence
  Description of Artificial Sequence: Synthetic oligonucleotide
accatcctggctaacacggt

SEQ ID NO: 6107 - DNA, 20 bp, Artificial Sequence
  Description of Artificial Sequence: Synthetic oligonucleotide
ccatcctggctaacacggtg

SEQ ID NO: 6108 - DNA, 20 bp, Artificial Sequence
  Description of Artificial Sequence: Synthetic oligonucleotide
catcctggctaacacggtga

SEQ ID NO: 6109 - DNA, 20 bp, Artificial Sequence
  Description of Artificial Sequence: Synthetic oligonucleotide
atcctggctaacacggtgaa

SEQ ID NO: 6110 - DNA, 20 bp, Artificial Sequence
  Description of Artificial Sequence: Synthetic oligonucleotide
tcctggctaacacggtgaaa

SEQ ID NO: 6111 - DNA, 20 bp, Artificial Sequence
  Description of Artificial Sequence: Synthetic oligonucleotide
cctggctaacacggtgaaac

SEQ ID NO: 6112 - DNA, 20 bp, Artificial Sequence
  Description of Artificial Sequence: Synthetic oligonucleotide
ctggctaacacggtgaaacc

SEQ ID NO: 6113 - DNA, 20 bp, Artificial Sequence
  Description of Artificial Sequence: Synthetic oligonucleotide
tggctaacacggtgaaaccc

SEQ ID NO: 6114 - DNA, 20 bp, Artificial Sequence
  Description of Artificial Sequence: Synthetic oligonucleotide
ggctaacacggtgaaacccc

SEQ ID NO: 6115 - DNA, 20 bp, Artificial Sequence
  Description of Artificial Sequence: Synthetic oligonucleotide
gctaacacggtgaaacccca

SEQ ID NO: 6116 - DNA, 20 bp, Artificial Sequence
  Description of Artificial Sequence: Synthetic oligonucleotide
ctaacacggtgaaaccccat

SEQ ID NO: 6117 - DNA, 20 bp, Artificial Sequence
  Description of Artificial Sequence: Synthetic oligonucleotide
taacacggtgaaaccccatc

SEQ ID NO: 6118 - DNA, 20 bp, Artificial Sequence
  Description of Artificial Sequence: Synthetic oligonucleotide
aacacggtgaaaccccatct

SEQ ID NO: 6119 - DNA, 20 bp, Artificial Sequence
  Description of Artificial Sequence: Synthetic oligonucleotide
acacggtgaaaccccatctc

SEQ ID NO: 6120 - DNA, 20 bp, Artificial Sequence
  Description of Artificial Sequence: Synthetic oligonucleotide
cacggtgaaaccccatctct

SEQ ID NO: 6121 - DNA, 20 bp, Artificial Sequence
  Description of Artificial Sequence: Synthetic oligonucleotide
acggtgaaaccccatctcta

SEQ ID NO: 6122 - DNA, 20 bp, Artificial Sequence
  Description of Artificial Sequence: Synthetic oligonucleotide
cggtgaaaccccatctctac

SEQ ID NO: 6123 - DNA, 20 bp, Artificial Sequence
  Description of Artificial Sequence: Synthetic oligonucleotide
ggtgaaaccccatctctact

SEQ ID NO: 6124 - DNA, 20 bp, Artificial Sequence
  Description of Artificial Sequence: Synthetic oligonucleotide
gtgaaaccccatctctacta

SEQ ID NO: 6125 - DNA, 20 bp, Artificial Sequence
  Description of Artificial Sequence: Synthetic oligonucleotide
tgaaaccccatctctactaa

SEQ ID NO: 6126 - DNA, 20 bp, Artificial Sequence
  Description of Artificial Sequence: Synthetic oligonucleotide
gaaaccccatctctactaaa

SEQ ID NO: 6127 - DNA, 20 bp, Artificial Sequence
  Description of Artificial Sequence: Synthetic oligonucleotide
aaaccccatctctactaaaa

SEQ ID NO: 6128 - DNA, 20 bp, Artificial Sequence
  Description of Artificial Sequence: Synthetic oligonucleotide
aaccccatctctactaaaaa

SEQ ID NO: 6129 - DNA, 20 bp, Artificial Sequence
  Description of Artificial Sequence: Synthetic oligonucleotide
accccatctctactaaaaat

SEQ ID NO: 6130 - DNA, 20 bp, Artificial Sequence
  Description of Artificial Sequence: Synthetic oligonucleotide
ccccatctctactaaaaata

SEQ ID NO: 6131 - DNA, 20 bp, Artificial Sequence
  Description of Artificial Sequence: Synthetic oligonucleotide
cccatctctactaaaaatac

SEQ ID NO: 6132 - DNA, 20 bp, Artificial Sequence
  Description of Artificial Sequence: Synthetic oligonucleotide
ccatctctactaaaaataca

SEQ ID NO: 6133 - DNA, 20 bp, Artificial Sequence
  Description of Artificial Sequence: Synthetic oligonucleotide
catctctactaaaaatacaa

SEQ ID NO: 6134 - DNA, 20 bp, Artificial Sequence
  Description of Artificial Sequence: Synthetic oligonucleotide
atctctactaaaaatacaaa

SEQ ID NO: 6135 - DNA, 20 bp, Artificial Sequence
  Description of Artificial Sequence: Synthetic oligonucleotide
tctctactaaaaatacaaaa

SEQ ID NO: 6136 - DNA, 20 bp, Artificial Sequence
  Description of Artificial Sequence: Synthetic oligonucleotide
ctctactaaaaatacaaaaa

SEQ ID NO: 6137 - DNA, 20 bp, Artificial Sequence
  Description of Artificial Sequence: Synthetic oligonucleotide
tctactaaaaatacaaaaaa

SEQ ID NO: 6138 - DNA, 20 bp, Artificial Sequence
  Description of Artificial Sequence: Synthetic oligonucleotide
ctactaaaaatacaaaaaaa

SEQ ID NO: 6139 - DNA, 20 bp, Artificial Sequence
  Description of Artificial Sequence: Synthetic oligonucleotide
tactaaaaatacaaaaaaat

SEQ ID NO: 6140 - DNA, 20 bp, Artificial Sequence
  Description of Artificial Sequence: Synthetic oligonucleotide
actaaaaatacaaaaaaatt

SEQ ID NO: 6141 - DNA, 20 bp, Artificial Sequence
  Description of Artificial Sequence: Synthetic oligonucleotide
ctaaaaatacaaaaaaatta

SEQ ID NO: 6142 - DNA, 20 bp, Artificial Sequence
  Description of Artificial Sequence: Synthetic oligonucleotide
taaaaatacaaaaaaattag

SEQ ID NO: 6143 - DNA, 20 bp, Artificial Sequence
  Description of Artificial Sequence: Synthetic oligonucleotide
aaaaatacaaaaaaattagc

SEQ ID NO: 6144 - DNA, 20 bp, Artificial Sequence
  Description of Artificial Sequence: Synthetic oligonucleotide
aaaatacaaaaaaattagcc

SEQ ID NO: 6145 - DNA, 20 bp, Artificial Sequence
  Description of Artificial Sequence: Synthetic oligonucleotide
aaatacaaaaaaattagcca

SEQ ID NO: 6146 - DNA, 20 bp, Artificial Sequence
  Description of Artificial Sequence: Synthetic oligonucleotide
aatacaaaaaaattagccag

SEQ ID NO: 6147 - DNA, 20 bp, Artificial Sequence
  Description of Artificial Sequence: Synthetic oligonucleotide
atacaaaaaaattagccagg

SEQ ID NO: 6148 - DNA, 20 bp, Artificial Sequence
  Description of Artificial Sequence: Synthetic oligonucleotide
tacaaaaaaattagccaggc

SEQ ID NO: 6149 - DNA, 20 bp, Artificial Sequence
  Description of Artificial Sequence: Synthetic oligonucleotide
acaaaaaaattagccaggcg

SEQ ID NO: 6150 - DNA, 20 bp, Artificial Sequence
  Description of Artificial Sequence: Synthetic oligonucleotide
caaaaaaattagccaggcgt

SEQ ID NO: 6151 - DNA, 20 bp, Artificial Sequence
  Description of Artificial Sequence: Synthetic oligonucleotide
aaaaaaattagccaggcgtg

SEQ ID NO: 6152 - DNA, 20 bp, Artificial Sequence
  Description of Artificial Sequence: Synthetic oligonucleotide
aaaaaattagccaggcgtgg

SEQ ID NO: 6153 - DNA, 20 bp, Artificial Sequence
  Description of Artificial Sequence: Synthetic oligonucleotide
aaaaattagccaggcgtggt

SEQ ID NO: 6154 - DNA, 20 bp, Artificial Sequence
  Description of Artificial Sequence: Synthetic oligonucleotide
aaaattagccaggcgtggtg

SEQ ID NO: 6155 - DNA, 20 bp, Artificial Sequence
  Description of Artificial Sequence: Synthetic oligonucleotide
aaattagccaggcgtggtgg

SEQ ID NO: 6156 - DNA, 20 bp, Artificial Sequence
  Description of Artificial Sequence: Synthetic oligonucleotide
aattagccaggcgtggtggt

SEQ ID NO: 6157 - DNA, 20 bp, Artificial Sequence
  Description of Artificial Sequence: Synthetic oligonucleotide
attagccaggcgtggtggtg

SEQ ID NO: 6158 - DNA, 20 bp, Artificial Sequence
  Description of Artificial Sequence: Synthetic oligonucleotide
ttagccaggcgtggtggtgg

SEQ ID NO: 6159 - DNA, 20 bp, Artificial Sequence
  Description of Artificial Sequence: Synthetic oligonucleotide
tagccaggcgtggtggtggg

SEQ ID NO: 6160 - DNA, 20 bp, Artificial Sequence
  Description of Artificial Sequence: Synthetic oligonucleotide
agccaggcgtggtggtgggc

SEQ ID NO: 6161 - DNA, 20 bp, Artificial Sequence
  Description of Artificial Sequence: Synthetic oligonucleotide
gccaggcgtggtggtgggca

SEQ ID NO: 6162 - DNA, 20 bp, Artificial Sequence
  Description of Artificial Sequence: Synthetic oligonucleotide
ccaggcgtggtggtgggcac

SEQ ID NO: 6163 - DNA, 20 bp, Artificial Sequence
  Description of Artificial Sequence: Synthetic oligonucleotide
caggcgtggtggtgggcacc

SEQ ID NO: 6164 - DNA, 20 bp, Artificial Sequence
  Description of Artificial Sequence: Synthetic oligonucleotide
aggcgtggtggtgggcacct

SEQ ID NO: 6165 - DNA, 20 bp, Artificial Sequence
  Description of Artificial Sequence: Synthetic oligonucleotide
ggcgtggtggtgggcaccta

SEQ ID NO: 6166 - DNA, 20 bp, Artificial Sequence
  Description of Artificial Sequence: Synthetic oligonucleotide
gcgtggtggtgggcacctat

SEQ ID NO: 6167 - DNA, 20 bp, Artificial Sequence
  Description of Artificial Sequence: Synthetic oligonucleotide
cgtggtggtgggcacctata

SEQ ID NO: 6168 - DNA, 20 bp, Artificial Sequence
  Description of Artificial Sequence: Synthetic oligonucleotide
gtggtggtgggcacctatag

SEQ ID NO: 6169 - DNA, 20 bp, Artificial Sequence
  Description of Artificial Sequence: Synthetic oligonucleotide
tggtggtgggcacctatagt

SEQ ID NO: 6170 - DNA, 20 bp, Artificial Sequence
  Description of Artificial Sequence: Synthetic oligonucleotide
ggtggtgggcacctatagtc

SEQ ID NO: 6171 - DNA, 20 bp, Artificial Sequence
  Description of Artificial Sequence: Synthetic oligonucleotide
gtggtgggcacctatagtcc

SEQ ID NO: 6172 - DNA, 20 bp, Artificial Sequence
  Description of Artificial Sequence: Synthetic oligonucleotide
tggtgggcacctatagtccc

SEQ ID NO: 6173 - DNA, 20 bp, Artificial Sequence
  Description of Artificial Sequence: Synthetic oligonucleotide
ggtgggcacctatagtccca

SEQ ID NO: 6174 - DNA, 20 bp, Artificial Sequence
  Description of Artificial Sequence: Synthetic oligonucleotide
gtgggcacctatagtcccag

SEQ ID NO: 6175 - DNA, 20 bp, Artificial Sequence
  Description of Artificial Sequence: Synthetic oligonucleotide
tgggcacctatagtcccagc

SEQ ID NO: 6176 - DNA, 20 bp, Artificial Sequence
  Description of Artificial Sequence: Synthetic oligonucleotide
gggcacctatagtcccagct

SEQ ID NO: 6177 - DNA, 20 bp, Artificial Sequence
  Description of Artificial Sequence: Synthetic oligonucleotide
ggcacctatagtcccagcta

SEQ ID NO: 6178 - DNA, 20 bp, Artificial Sequence
  Description of Artificial Sequence: Synthetic oligonucleotide
gcacctatagtcccagctac

SEQ ID NO: 6179 - DNA, 20 bp, Artificial Sequence
  Description of Artificial Sequence: Synthetic oligonucleotide
cacctatagtcccagctact

SEQ ID NO: 6180 - DNA, 20 bp, Artificial Sequence
  Description of Artificial Sequence: Synthetic oligonucleotide
acctatagtcccagctactc

SEQ ID NO: 6181 - DNA, 20 bp, Artificial Sequence
  Description of Artificial Sequence: Synthetic oligonucleotide
cctatagtcccagctactcg

SEQ ID NO: 6182 - DNA, 20 bp, Artificial Sequence
  Description of Artificial Sequence: Synthetic oligonucleotide
ctatagtcccagctactcgg

SEQ ID NO: 6183 - DNA, 20 bp, Artificial Sequence
  Description of Artificial Sequence: Synthetic oligonucleotide
tatagtcccagctactcggg

SEQ ID NO: 6184 - DNA, 20 bp, Artificial Sequence
  Description of Artificial Sequence: Synthetic oligonucleotide
atagtcccagctactcggga

SEQ ID NO: 6185 - DNA, 20 bp, Artificial Sequence
  Description of Artificial Sequence: Synthetic oligonucleotide
tagtcccagctactcgggag

SEQ ID NO: 6186 - DNA, 20 bp, Artificial Sequence
  Description of Artificial Sequence: Synthetic oligonucleotide
agtcccagctactcgggagg

SEQ ID NO: 6187 - DNA, 20 bp, Artificial Sequence
  Description of Artificial Sequence: Synthetic oligonucleotide
gtcccagctactcgggaggc

SEQ ID NO: 6188 - DNA, 20 bp, Artificial Sequence
  Description of Artificial Sequence: Synthetic oligonucleotide
tcccagctactcgggaggct

SEQ ID NO: 6189 - DNA, 20 bp, Artificial Sequence
  Description of Artificial Sequence: Synthetic oligonucleotide
cccagctactcgggaggctg

SEQ ID NO: 6190 - DNA, 20 bp, Artificial Sequence
  Description of Artificial Sequence: Synthetic oligonucleotide
ccagctactcgggaggctga

SEQ ID NO: 6191 - DNA, 20 bp, Artificial Sequence
  Description of Artificial Sequence: Synthetic oligonucleotide
cagctactcgggaggctgag

SEQ ID NO: 6192 - DNA, 20 bp, Artificial Sequence
  Description of Artificial Sequence: Synthetic oligonucleotide
agctactcgggaggctgagg

SEQ ID NO: 6193 - DNA, 20 bp, Artificial Sequence
  Description of Artificial Sequence: Synthetic oligonucleotide
gctactcgggaggctgaggc

SEQ ID NO: 6194 - DNA, 20 bp, Artificial Sequence
  Description of Artificial Sequence: Synthetic oligonucleotide
ctactcgggaggctgaggca

SEQ ID NO: 6195 - DNA, 20 bp, Artificial Sequence
  Description of Artificial Sequence: Synthetic oligonucleotide
tactcgggaggctgaggcag

SEQ ID NO: 6196 - DNA, 20 bp, Artificial Sequence
  Description of Artificial Sequence: Synthetic oligonucleotide
actcgggaggctgaggcagg

SEQ ID NO: 6197 - DNA, 20 bp, Artificial Sequence
  Description of Artificial Sequence: Synthetic oligonucleotide
ctcgggaggctgaggcagga

SEQ ID NO: 6198 - DNA, 20 bp, Artificial Sequence
  Description of Artificial Sequence: Synthetic oligonucleotide
tcgggaggctgaggcaggag

SEQ ID NO: 6199 - DNA, 20 bp, Artificial Sequence
  Description of Artificial Sequence: Synthetic oligonucleotide
cgggaggctgaggcaggaga

SEQ ID NO: 6200 - DNA, 20 bp, Artificial Sequence
  Description of Artificial Sequence: Synthetic oligonucleotide
gggaggctgaggcaggagaa

SEQ ID NO: 6201 - DNA, 20 bp, Artificial Sequence
  Description of Artificial Sequence: Synthetic oligonucleotide
ggaggctgaggcaggagaat

SEQ ID NO: 6202 - DNA, 20 bp, Artificial Sequence
  Description of Artificial Sequence: Synthetic oligonucleotide
gaggctgaggcaggagaatg

SEQ ID NO: 6203 - DNA, 20 bp, Artificial Sequence
  Description of Artificial Sequence: Synthetic oligonucleotide
aggctgaggcaggagaatgg

SEQ ID NO: 6204 - DNA, 20 bp, Artificial Sequence
  Description of Artificial Sequence: Synthetic oligonucleotide
ggctgaggcaggagaatggt

SEQ ID NO: 6205 - DNA, 20 bp, Artificial Sequence
  Description of Artificial Sequence: Synthetic oligonucleotide
gctgaggcaggagaatggtg

SEQ ID NO: 6206 - DNA, 20 bp, Artificial Sequence
  Description of Artificial Sequence: Synthetic oligonucleotide
ctgaggcaggagaatggtgt

SEQ ID NO: 6207 - DNA, 20 bp, Artificial Sequence
  Description of Artificial Sequence: Synthetic oligonucleotide
tgaggcaggagaatggtgtg

SEQ ID NO: 6208 - DNA, 20 bp, Artificial Sequence
  Description of Artificial Sequence: Synthetic oligonucleotide
gaggcaggagaatggtgtga

SEQ ID NO: 6209 - DNA, 20 bp, Artificial Sequence
  Description of Artificial Sequence: Synthetic oligonucleotide
aggcaggagaatggtgtgaa

SEQ ID NO: 6210 - DNA, 20 bp, Artificial Sequence
  Description of Artificial Sequence: Synthetic oligonucleotide
ggcaggagaatggtgtgaac

SEQ ID NO: 6211 - DNA, 20 bp, Artificial Sequence
  Description of Artificial Sequence: Synthetic oligonucleotide
gcaggagaatggtgtgaact

SEQ ID NO: 6212 - DNA, 20 bp, Artificial Sequence
  Description of Artificial Sequence: Synthetic oligonucleotide
caggagaatggtgtgaactc

SEQ ID NO: 6213 - DNA, 20 bp, Artificial Sequence
  Description of Artificial Sequence: Synthetic oligonucleotide
aggagaatggtgtgaactca

SEQ ID NO: 6214 - DNA, 20 bp, Artificial Sequence
  Description of Artificial Sequence: Synthetic oligonucleotide
ggagaatggtgtgaactcag

SEQ ID NO: 6215 - DNA, 20 bp, Artificial Sequence
  Description of Artificial Sequence: Synthetic oligonucleotide
gagaatggtgtgaactcagg

SEQ ID NO: 6216 - DNA, 20 bp, Artificial Sequence
  Description of Artificial Sequence: Synthetic oligonucleotide
agaatggtgtgaactcagga

SEQ ID NO: 6217 - DNA, 20 bp, Artificial Sequence
  Description of Artificial Sequence: Synthetic oligonucleotide
gaatggtgtgaactcaggag

SEQ ID NO: 6218 - DNA, 20 bp, Artificial Sequence
  Description of Artificial Sequence: Synthetic oligonucleotide
aatggtgtgaactcaggagg

SEQ ID NO: 6219 - DNA, 20 bp, Artificial Sequence
  Description of Artificial Sequence: Synthetic oligonucleotide
atggtgtgaactcaggaggt

SEQ ID NO: 6220 - DNA, 20 bp, Artificial Sequence
  Description of Artificial Sequence: Synthetic oligonucleotide
tggtgtgaactcaggaggtg

SEQ ID NO: 6221 - DNA, 20 bp, Artificial Sequence
  Description of Artificial Sequence: Synthetic oligonucleotide
ggtgtgaactcaggaggtgg

SEQ ID NO: 6222 - DNA, 20 bp, Artificial Sequence
  Description of Artificial Sequence: Synthetic oligonucleotide
gtgtgaactcaggaggtgga

SEQ ID NO: 6223 - DNA, 20 bp, Artificial Sequence
  Description of Artificial Sequence: Synthetic oligonucleotide
tgtgaactcaggaggtggag

SEQ ID NO: 6224 - DNA, 20 bp, Artificial Sequence
  Description of Artificial Sequence: Synthetic oligonucleotide
gtgaactcaggaggtggagc

SEQ ID NO: 6225 - DNA, 20 bp, Artificial Sequence
  Description of Artificial Sequence: Synthetic oligonucleotide
tgaactcaggaggtggagct

SEQ ID NO: 6226 - DNA, 20 bp, Artificial Sequence
  Description of Artificial Sequence: Synthetic oligonucleotide
gaactcaggaggtggagctt

SEQ ID NO: 6227 - DNA, 20 bp, Artificial Sequence
  Description of Artificial Sequence: Synthetic oligonucleotide
aactcaggaggtggagcttg

SEQ ID NO: 6228 - DNA, 20 bp, Artificial Sequence
  Description of Artificial Sequence: Synthetic oligonucleotide
actcaggaggtggagcttgc

SEQ ID NO: 6229 - DNA, 20 bp, Artificial Sequence
  Description of Artificial Sequence: Synthetic oligonucleotide
ctcaggaggtggagcttgca

SEQ ID NO: 6230 - DNA, 20 bp, Artificial Sequence
  Description of Artificial Sequence: Synthetic oligonucleotide
tcaggaggtggagcttgcag

SEQ ID NO: 6231 - DNA, 20 bp, Artificial Sequence
  Description of Artificial Sequence: Synthetic oligonucleotide
caggaggtggagcttgcagt

SEQ ID NO: 6232 - DNA, 20 bp, Artificial Sequence
  Description of Artificial Sequence: Synthetic oligonucleotide
aggaggtggagcttgcagtg

SEQ ID NO: 6233 - DNA, 20 bp, Artificial Sequence
  Description of Artificial Sequence: Synthetic oligonucleotide
ggaggtggagcttgcagtga

SEQ ID NO: 6234 - DNA, 20 bp, Artificial Sequence
  Description of Artificial Sequence: Synthetic oligonucleotide
gaggtggagcttgcagtgag

SEQ ID NO: 6235 - DNA, 20 bp, Artificial Sequence
  Description of Artificial Sequence: Synthetic oligonucleotide
aggtggagcttgcagtgagc

SEQ ID NO: 6236 - DNA, 20 bp, Artificial Sequence
  Description of Artificial Sequence: Synthetic oligonucleotide
ggtggagcttgcagtgagcc

SEQ ID NO: 6237 - DNA, 20 bp, Artificial Sequence
  Description of Artificial Sequence: Synthetic oligonucleotide
gtggagcttgcagtgagcca

SEQ ID NO: 6238 - DNA, 20 bp, Artificial Sequence
  Description of Artificial Sequence: Synthetic oligonucleotide
tggagcttgcagtgagccaa

SEQ ID NO: 6239 - DNA, 20 bp, Artificial Sequence
  Description of Artificial Sequence: Synthetic oligonucleotide
ggagcttgcagtgagccaag

SEQ ID NO: 6240 - DNA, 20 bp, Artificial Sequence
  Description of Artificial Sequence: Synthetic oligonucleotide
gagcttgcagtgagccaaga

SEQ ID NO: 6241 - DNA, 20 bp, Artificial Sequence
  Description of Artificial Sequence: Synthetic oligonucleotide
agcttgcagtgagccaagat

SEQ ID NO: 6242 - DNA, 20 bp, Artificial Sequence
  Description of Artificial Sequence: Synthetic oligonucleotide
gcttgcagtgagccaagatc

SEQ ID NO: 6243 - DNA, 20 bp, Artificial Sequence
  Description of Artificial Sequence: Synthetic oligonucleotide
cttgcagtgagccaagatcg

SEQ ID NO: 6244 - DNA, 20 bp, Artificial Sequence
  Description of Artificial Sequence: Synthetic oligonucleotide
ttgcagtgagccaagatcgt

SEQ ID NO: 6245 - DNA, 20 bp, Artificial Sequence
  Description of Artificial Sequence: Synthetic oligonucleotide
tgcagtgagccaagatcgtg

SEQ ID NO: 6246 - DNA, 20 bp, Artificial Sequence
  Description of Artificial Sequence: Synthetic oligonucleotide
gcagtgagccaagatcgtgc

SEQ ID NO: 6247 - DNA, 20 bp, Artificial Sequence
  Description of Artificial Sequence: Synthetic oligonucleotide
cagtgagccaagatcgtgcc

SEQ ID NO: 6248 - DNA, 20 bp, Artificial Sequence
  Description of Artificial Sequence: Synthetic oligonucleotide
agtgagccaagatcgtgcca

SEQ ID NO: 6249 - DNA, 20 bp, Artificial Sequence
  Description of Artificial Sequence: Synthetic oligonucleotide
gtgagccaagatcgtgccac

SEQ ID NO: 6250 - DNA, 20 bp, Artificial Sequence
  Description of Artificial Sequence: Synthetic oligonucleotide
tgagccaagatcgtgccaca

SEQ ID NO: 6251 - DNA, 20 bp, Artificial Sequence
  Description of Artificial Sequence: Synthetic oligonucleotide
gagccaagatcgtgccacaa

SEQ ID NO: 6252 - DNA, 20 bp, Artificial Sequence
  Description of Artificial Sequence: Synthetic oligonucleotide
agccaagatcgtgccacaaa

SEQ ID NO: 6253 - DNA, 20 bp, Artificial Sequence
  Description of Artificial Sequence: Synthetic oligonucleotide
gccaagatcgtgccacaaag

SEQ ID NO: 6254 - DNA, 20 bp, Artificial Sequence
  Description of Artificial Sequence: Synthetic oligonucleotide
ccaagatcgtgccacaaagc

SEQ ID NO: 6255 - DNA, 20 bp, Artificial Sequence
  Description of Artificial Sequence: Synthetic oligonucleotide
caagatcgtgccacaaagca

SEQ ID NO: 6256 - DNA, 20 bp, Artificial Sequence
  Description of Artificial Sequence: Synthetic oligonucleotide
aagatcgtgccacaaagcac

SEQ ID NO: 6257 - DNA, 20 bp, Artificial Sequence
  Description of Artificial Sequence: Synthetic oligonucleotide
agatcgtgccacaaagcact

SEQ ID NO: 6258 - DNA, 20 bp, Artificial Sequence
  Description of Artificial Sequence: Synthetic oligonucleotide
gatcgtgccacaaagcactc

SEQ ID NO: 6259 - DNA, 20 bp, Artificial Sequence
  Description of Artificial Sequence: Synthetic oligonucleotide
atcgtgccacaaagcactcc

SEQ ID NO: 6260 - DNA, 20 bp, Artificial Sequence
  Description of Artificial Sequence: Synthetic oligonucleotide
tcgtgccacaaagcactcca

SEQ ID NO: 6261 - DNA, 20 bp, Artificial Sequence
  Description of Artificial Sequence: Synthetic oligonucleotide
cgtgccacaaagcactccag

SEQ ID NO: 6262 - DNA, 20 bp, Artificial Sequence
  Description of Artificial Sequence: Synthetic oligonucleotide
gtgccacaaagcactccagc

SEQ ID NO: 6263 - DNA, 20 bp, Artificial Sequence
  Description of Artificial Sequence: Synthetic oligonucleotide
tgccacaaagcactccagcc

SEQ ID NO: 6264 - DNA, 20 bp, Artificial Sequence
  Description of Artificial Sequence: Synthetic oligonucleotide
gccacaaagcactccagcct

SEQ ID NO: 6265 - DNA, 20 bp, Artificial Sequence
  Description of Artificial Sequence: Synthetic oligonucleotide
ccacaaagcactccagcctg

SEQ ID NO: 6266 - DNA, 20 bp, Artificial Sequence
  Description of Artificial Sequence: Synthetic oligonucleotide
cacaaagcactccagcctgg

SEQ ID NO: 6267 - DNA, 20 bp, Artificial Sequence
  Description of Artificial Sequence: Synthetic oligonucleotide
acaaagcactccagcctggg

SEQ ID NO: 6268 - DNA, 20 bp, Artificial Sequence
  Description of Artificial Sequence: Synthetic oligonucleotide
caaagcactccagcctgggt

SEQ ID NO: 6269 - DNA, 20 bp, Artificial Sequence
  Description of Artificial Sequence: Synthetic oligonucleotide
aaagcactccagcctgggtg

SEQ ID NO: 6270 - DNA, 20 bp, Artificial Sequence
  Description of Artificial Sequence: Synthetic oligonucleotide
aagcactccagcctgggtga

SEQ ID NO: 6271 - DNA, 20 bp, Artificial Sequence
  Description of Artificial Sequence: Synthetic oligonucleotide
agcactccagcctgggtgac

SEQ ID NO: 6272 - DNA, 20 bp, Artificial Sequence
  Description of Artificial Sequence: Synthetic oligonucleotide
gcactccagcctgggtgaca

SEQ ID NO: 6273 - DNA, 20 bp, Artificial Sequence
  Description of Artificial Sequence: Synthetic oligonucleotide
cactccagcctgggtgacaa

SEQ ID NO: 6274 - DNA, 20 bp, Artificial Sequence
  Description of Artificial Sequence: Synthetic oligonucleotide
actccagcctgggtgacaaa

SEQ ID NO: 6275 - DNA, 20 bp, Artificial Sequence
  Description of Artificial Sequence: Synthetic oligonucleotide
ctccagcctgggtgacaaag

SEQ ID NO: 6276 - DNA, 20 bp, Artificial Sequence
  Description of Artificial Sequence: Synthetic oligonucleotide
tccagcctgggtgacaaagt

SEQ ID NO: 6277 - DNA, 20 bp, Artificial Sequence
  Description of Artificial Sequence: Synthetic oligonucleotide
ccagcctgggtgacaaagtg

SEQ ID NO: 6278 - DNA, 20 bp, Artificial Sequence
  Description of Artificial Sequence: Synthetic oligonucleotide
cagcctgggtgacaaagtga

SEQ ID NO: 6279 - DNA, 20 bp, Artificial Sequence
  Description of Artificial Sequence: Synthetic oligonucleotide
agcctgggtgacaaagtgag

SEQ ID NO: 6280 - DNA, 20 bp, Artificial Sequence
  Description of Artificial Sequence: Synthetic oligonucleotide
gcctgggtgacaaagtgaga

SEQ ID NO: 6281 - DNA, 20 bp, Artificial Sequence
  Description of Artificial Sequence: Synthetic oligonucleotide
cctgggtgacaaagtgagac

SEQ ID NO: 6282 - DNA, 20 bp, Artificial Sequence
  Description of Artificial Sequence: Synthetic oligonucleotide
ctgggtgacaaagtgagact

SEQ ID NO: 6283 - DNA, 20 bp, Artificial Sequence
  Description of Artificial Sequence: Synthetic oligonucleotide
tgggtgacaaagtgagactc

SEQ ID NO: 6284 - DNA, 20 bp, Artificial Sequence
  Description of Artificial Sequence: Synthetic oligonucleotide
gggtgacaaagtgagactcc

SEQ ID NO: 6285 - DNA, 20 bp, Artificial Sequence
  Description of Artificial Sequence: Synthetic oligonucleotide
ggtgacaaagtgagactccg

SEQ ID NO: 6286 - DNA, 20 bp, Artificial Sequence
  Description of Artificial Sequence: Synthetic oligonucleotide
gtgacaaagtgagactccgt

SEQ ID NO: 6287 - DNA, 20 bp, Artificial Sequence
  Description of Artificial Sequence: Synthetic oligonucleotide
tgacaaagtgagactccgtc

SEQ ID NO: 6288 - DNA, 20 bp, Artificial Sequence
  Description of Artificial Sequence: Synthetic oligonucleotide
gacaaagtgagactccgtct

SEQ ID NO: 6289 - DNA, 20 bp, Artificial Sequence
  Description of Artificial Sequence: Synthetic oligonucleotide
acaaagtgagactccgtctc

SEQ ID NO: 6290 - DNA, 20 bp, Artificial Sequence
  Description of Artificial Sequence: Synthetic oligonucleotide
caaagtgagactccgtctca

SEQ ID NO: 6291 - DNA, 20 bp, Artificial Sequence
  Description of Artificial Sequence: Synthetic oligonucleotide
aaagtgagactccgtctcaa

SEQ ID NO: 6292 - DNA, 20 bp, Artificial Sequence
  Description of Artificial Sequence: Synthetic oligonucleotide
aagtgagactccgtctcaaa

SEQ ID NO: 6293 - DNA, 20 bp, Artificial Sequence
  Description of Artificial Sequence: Synthetic oligonucleotide
agtgagactccgtctcaaaa

SEQ ID NO: 6294 - DNA, 20 bp, Artificial Sequence
  Description of Artificial Sequence: Synthetic oligonucleotide
gtgagactccgtctcaaaaa

SEQ ID NO: 6295 - DNA, 20 bp, Artificial Sequence
  Description of Artificial Sequence: Synthetic oligonucleotide
tgagactccgtctcaaaaaa

SEQ ID NO: 6296 - DNA, 20 bp, Artificial Sequence
  Description of Artificial Sequence: Synthetic oligonucleotide
gagactccgtctcaaaaaat

SEQ ID NO: 6297 - DNA, 20 bp, Artificial Sequence
  Description of Artificial Sequence: Synthetic oligonucleotide
agactccgtctcaaaaaata

SEQ ID NO: 6298 - DNA, 20 bp, Artificial Sequence
  Description of Artificial Sequence: Synthetic oligonucleotide
gactccgtctcaaaaaataa

SEQ ID NO: 6299 - DNA, 20 bp, Artificial Sequence
  Description of Artificial Sequence: Synthetic oligonucleotide
actccgtctcaaaaaataaa

SEQ ID NO: 6300 - DNA, 20 bp, Artificial Sequence
  Description of Artificial Sequence: Synthetic oligonucleotide
ctccgtctcaaaaaataaat

SEQ ID NO: 6301 - DNA, 20 bp, Artificial Sequence
  Description of Artificial Sequence: Synthetic oligonucleotide
tccgtctcaaaaaataaata

SEQ ID NO: 6302 - DNA, 20 bp, Artificial Sequence
  Description of Artificial Sequence: Synthetic oligonucleotide
ccgtctcaaaaaataaatac

SEQ ID NO: 6303 - DNA, 20 bp, Artificial Sequence
  Description of Artificial Sequence: Synthetic oligonucleotide
cgtctcaaaaaataaataca

SEQ ID NO: 6304 - DNA, 20 bp, Artificial Sequence
  Description of Artificial Sequence: Synthetic oligonucleotide
gtctcaaaaaataaatacat

SEQ ID NO: 6305 - DNA, 20 bp, Artificial Sequence
  Description of Artificial Sequence: Synthetic oligonucleotide
tctcaaaaaataaatacata

SEQ ID NO: 6306 - DNA, 20 bp, Artificial Sequence
  Description of Artificial Sequence: Synthetic oligonucleotide
ctcaaaaaataaatacataa

SEQ ID NO: 6307 - DNA, 20 bp, Artificial Sequence
  Description of Artificial Sequence: Synthetic oligonucleotide
tcaaaaaataaatacataaa

SEQ ID NO: 6308 - DNA, 20 bp, Artificial Sequence
  Description of Artificial Sequence: Synthetic oligonucleotide
caaaaaataaatacataaat

SEQ ID NO: 6309 - DNA, 20 bp, Artificial Sequence
  Description of Artificial Sequence: Synthetic oligonucleotide
aaaaaataaatacataaata

SEQ ID NO: 6310 - DNA, 20 bp, Artificial Sequence
  Description of Artificial Sequence: Synthetic oligonucleotide
aaaaataaatacataaataa

SEQ ID NO: 6311 - DNA, 20 bp, Artificial Sequence
  Description of Artificial Sequence: Synthetic oligonucleotide
aaaataaatacataaataaa

SEQ ID NO: 6312 - DNA, 20 bp, Artificial Sequence
  Description of Artificial Sequence: Synthetic oligonucleotide
aaataaatacataaataaat

SEQ ID NO: 6313 - DNA, 20 bp, Artificial Sequence
  Description of Artificial Sequence: Synthetic oligonucleotide
aataaatacataaataaata

SEQ ID NO: 6314 - DNA, 20 bp, Artificial Sequence
  Description of Artificial Sequence: Synthetic oligonucleotide
ataaatacataaataaataa

SEQ ID NO: 6315 - DNA, 20 bp, Artificial Sequence
  Description of Artificial Sequence: Synthetic oligonucleotide
taaatacataaataaataaa

SEQ ID NO: 6316 - DNA, 20 bp, Artificial Sequence
  Description of Artificial Sequence: Synthetic oligonucleotide
aaatacataaataaataaat

SEQ ID NO: 6317 - DNA, 20 bp, Artificial Sequence
  Description of Artificial Sequence: Synthetic oligonucleotide
aatacataaataaataaata

SEQ ID NO: 6318 - DNA, 20 bp, Artificial Sequence
  Description of Artificial Sequence: Synthetic oligonucleotide
atacataaataaataaataa

SEQ ID NO: 6319 - DNA, 20 bp, Artificial Sequence
  Description of Artificial Sequence: Synthetic oligonucleotide
tacataaataaataaataaa

SEQ ID NO: 6320 - DNA, 20 bp, Artificial Sequence
  Description of Artificial Sequence: Synthetic oligonucleotide
acataaataaataaataaac

SEQ ID NO: 6321 - DNA, 20 bp, Artificial Sequence
  Description of Artificial Sequence: Synthetic oligonucleotide
cataaataaataaataaaca

SEQ ID NO: 6322 - DNA, 20 bp, Artificial Sequence
  Description of Artificial Sequence: Synthetic oligonucleotide
ataaataaataaataaacaa

SEQ ID NO: 6323 - DNA, 20 bp, Artificial Sequence
  Description of Artificial Sequence: Synthetic oligonucleotide
taaataaataaataaacaaa

SEQ ID NO: 6324 - DNA, 20 bp, Artificial Sequence
  Description of Artificial Sequence: Synthetic oligonucleotide
aaataaataaataaacaaac

SEQ ID NO: 6325 - DNA, 20 bp, Artificial Sequence
  Description of Artificial Sequence: Synthetic oligonucleotide
aataaataaataaacaaaca

SEQ ID NO: 6326 - DNA, 20 bp, Artificial Sequence
  Description of Artificial Sequence: Synthetic oligonucleotide
ataaataaataaacaaacac

SEQ ID NO: 6327 - DNA, 20 bp, Artificial Sequence
  Description of Artificial Sequence: Synthetic oligonucleotide
taaataaataaacaaacaca

SEQ ID NO: 6328 - DNA, 20 bp, Artificial Sequence
  Description of Artificial Sequence: Synthetic oligonucleotide
aaataaataaacaaacacat

SEQ ID NO: 6329 - DNA, 20 bp, Artificial Sequence
  Description of Artificial Sequence: Synthetic oligonucleotide
aataaataaacaaacacata

SEQ ID NO: 6330 - DNA, 20 bp, Artificial Sequence
  Description of Artificial Sequence: Synthetic oligonucleotide
ataaataaacaaacacataa

SEQ ID NO: 6331 - DNA, 20 bp, Artificial Sequence
  Description of Artificial Sequence: Synthetic oligonucleotide
taaataaacaaacacataag

SEQ ID NO: 6332 - DNA, 20 bp, Artificial Sequence
  Description of Artificial Sequence: Synthetic oligonucleotide
aaataaacaaacacataagt

SEQ ID NO: 6333 - DNA, 20 bp, Artificial Sequence
  Description of Artificial Sequence: Synthetic oligonucleotide
aataaacaaacacataagta

SEQ ID NO: 6334 - DNA, 20 bp, Artificial Sequence
  Description of Artificial Sequence: Synthetic oligonucleotide
ataaacaaacacataagtaa

SEQ ID NO: 6335 - DNA, 20 bp, Artificial Sequence
  Description of Artificial Sequence: Synthetic oligonucleotide
taaacaaacacataagtaaa

SEQ ID NO: 6336 - DNA, 20 bp, Artificial Sequence
  Description of Artificial Sequence: Synthetic oligonucleotide
aaacaaacacataagtaaat

SEQ ID NO: 6337 - DNA, 20 bp, Artificial Sequence
  Description of Artificial Sequence: Synthetic oligonucleotide
aacaaacacataagtaaata

SEQ ID NO: 6338 - DNA, 20 bp, Artificial Sequence
  Description of Artificial Sequence: Synthetic oligonucleotide
acaaacacataagtaaataa

SEQ ID NO: 6339 - DNA, 20 bp, Artificial Sequence
  Description of Artificial Sequence: Synthetic oligonucleotide
caaacacataagtaaataaa

SEQ ID NO: 6340 - DNA, 20 bp, Artificial Sequence
  Description of Artificial Sequence: Synthetic oligonucleotide
aaacacataagtaaataaaa

SEQ ID NO: 6341 - DNA, 20 bp, Artificial Sequence
  Description of Artificial Sequence: Synthetic oligonucleotide
aacacataagtaaataaaag

SEQ ID NO: 6342 - DNA, 20 bp, Artificial Sequence
  Description of Artificial Sequence: Synthetic oligonucleotide
acacataagtaaataaaagt

SEQ ID NO: 6343 - DNA, 20 bp, Artificial Sequence
  Description of Artificial Sequence: Synthetic oligonucleotide
cacataagtaaataaaagta

SEQ ID NO: 6344 - DNA, 20 bp, Artificial Sequence
  Description of Artificial Sequence: Synthetic oligonucleotide
acataagtaaataaaagtaa

SEQ ID NO: 6345 - DNA, 20 bp, Artificial Sequence
  Description of Artificial Sequence: Synthetic oligonucleotide
cataagtaaataaaagtaaa

SEQ ID NO: 6346 - DNA, 20 bp, Artificial Sequence
  Description of Artificial Sequence: Synthetic oligonucleotide
ataagtaaataaaagtaaag

SEQ ID NO: 6347 - DNA, 20 bp, Artificial Sequence
  Description of Artificial Sequence: Synthetic oligonucleotide
taagtaaataaaagtaaaga

SEQ ID NO: 6348 - DNA, 20 bp, Artificial Sequence
  Description of Artificial Sequence: Synthetic oligonucleotide
aagtaaataaaagtaaagac

SEQ ID NO: 6349 - DNA, 20 bp, Artificial Sequence
  Description of Artificial Sequence: Synthetic oligonucleotide
agtaaataaaagtaaagacg

SEQ ID NO: 6350 - DNA, 20 bp, Artificial Sequence
  Description of Artificial Sequence: Synthetic oligonucleotide
gtaaataaaagtaaagacgg

SEQ ID NO: 6351 - DNA, 20 bp, Artificial Sequence
  Description of Artificial Sequence: Synthetic oligonucleotide
taaataaaagtaaagacggt

SEQ ID NO: 6352 - DNA, 20 bp, Artificial Sequence
  Description of Artificial Sequence: Synthetic oligonucleotide
aaataaaagtaaagacggtc

SEQ ID NO: 6353 - DNA, 20 bp, Artificial Sequence
  Description of Artificial Sequence: Synthetic oligonucleotide
aataaaagtaaagacggtca

SEQ ID NO: 6354 - DNA, 20 bp, Artificial Sequence
  Description of Artificial Sequence: Synthetic oligonucleotide
ataaaagtaaagacggtcaa

SEQ ID NO: 6355 - DNA, 20 bp, Artificial Sequence
  Description of Artificial Sequence: Synthetic oligonucleotide
taaaagtaaagacggtcaag

SEQ ID NO: 6356 - DNA, 20 bp, Artificial Sequence
  Description of Artificial Sequence: Synthetic oligonucleotide
aaaagtaaagacggtcaaga

SEQ ID NO: 6357 - DNA, 20 bp, Artificial Sequence
  Description of Artificial Sequence: Synthetic oligonucleotide
aaagtaaagacggtcaagac

SEQ ID NO: 6358 - DNA, 20 bp, Artificial Sequence
  Description of Artificial Sequence: Synthetic oligonucleotide
aagtaaagacggtcaagacc

SEQ ID NO: 6359 - DNA, 20 bp, Artificial Sequence
  Description of Artificial Sequence: Synthetic oligonucleotide
agtaaagacggtcaagaccc

SEQ ID NO: 6360 - DNA, 20 bp, Artificial Sequence
  Description of Artificial Sequence: Synthetic oligonucleotide
gtaaagacggtcaagaccct

SEQ ID NO: 6361 - DNA, 20 bp, Artificial Sequence
  Description of Artificial Sequence: Synthetic oligonucleotide
taaagacggtcaagaccctt

SEQ ID NO: 6362 - DNA, 20 bp, Artificial Sequence
  Description of Artificial Sequence: Synthetic oligonucleotide
aaagacggtcaagacccttt

SEQ ID NO: 6363 - DNA, 20 bp, Artificial Sequence
  Description of Artificial Sequence: Synthetic oligonucleotide
aagacggtcaagaccctttt

SEQ ID NO: 6364 - DNA, 20 bp, Artificial Sequence
  Description of Artificial Sequence: Synthetic oligonucleotide
agacggtcaagacccttttc

SEQ ID NO: 6365 - DNA, 20 bp, Artificial Sequence
  Description of Artificial Sequence: Synthetic oligonucleotide
gacggtcaagacccttttca

SEQ ID NO: 6366 - DNA, 20 bp, Artificial Sequence
  Description of Artificial Sequence: Synthetic oligonucleotide
acggtcaagacccttttcag

SEQ ID NO: 6367 - DNA, 20 bp, Artificial Sequence
  Description of Artificial Sequence: Synthetic oligonucleotide
cggtcaagacccttttcagg

SEQ ID NO: 6368 - DNA, 20 bp, Artificial Sequence
  Description of Artificial Sequence: Synthetic oligonucleotide
ggtcaagacccttttcagga

SEQ ID NO: 6369 - DNA, 20 bp, Artificial Sequence
  Description of Artificial Sequence: Synthetic oligonucleotide
gtcaagacccttttcaggat

SEQ ID NO: 6370 - DNA, 20 bp, Artificial Sequence
  Description of Artificial Sequence: Synthetic oligonucleotide
tcaagacccttttcaggatg

SEQ ID NO: 6371 - DNA, 20 bp, Artificial Sequence
  Description of Artificial Sequence: Synthetic oligonucleotide
caagacccttttcaggatgg

SEQ ID NO: 6372 - DNA, 20 bp, Artificial Sequence
  Description of Artificial Sequence: Synthetic oligonucleotide
aagacccttttcaggatggg

SEQ ID NO: 6373 - DNA, 20 bp, Artificial Sequence
  Description of Artificial Sequence: Synthetic oligonucleotide
agacccttttcaggatggga

SEQ ID NO: 6374 - DNA, 20 bp, Artificial Sequence
  Description of Artificial Sequence: Synthetic oligonucleotide
gacccttttcaggatgggaa

SEQ ID NO: 6375 - DNA, 20 bp, Artificial Sequence
  Description of Artificial Sequence: Synthetic oligonucleotide
acccttttcaggatgggaaa

SEQ ID NO: 6376 - DNA, 20 bp, Artificial Sequence
  Description of Artificial Sequence: Synthetic oligonucleotide
cccttttcaggatgggaaaa

SEQ ID NO: 6377 - DNA, 20 bp, Artificial Sequence
  Description of Artificial Sequence: Synthetic oligonucleotide
ccttttcaggatgggaaaac

SEQ ID NO: 6378 - DNA, 20 bp, Artificial Sequence
  Description of Artificial Sequence: Synthetic oligonucleotide
cttttcaggatgggaaaact

SEQ ID NO: 6379 - DNA, 20 bp, Artificial Sequence
  Description of Artificial Sequence: Synthetic oligonucleotide
ttttcaggatgggaaaactg

SEQ ID NO: 6380 - DNA, 20 bp, Artificial Sequence
  Description of Artificial Sequence: Synthetic oligonucleotide
tttcaggatgggaaaactga

SEQ ID NO: 6381 - DNA, 20 bp, Artificial Sequence
  Description of Artificial Sequence: Synthetic oligonucleotide
ttcaggatgggaaaactgag

SEQ ID NO: 6382 - DNA, 20 bp, Artificial Sequence
  Description of Artificial Sequence: Synthetic oligonucleotide
tcaggatgggaaaactgagg

SEQ ID NO: 6383 - DNA, 20 bp, Artificial Sequence
  Description of Artificial Sequence: Synthetic oligonucleotide
caggatgggaaaactgaggc

SEQ ID NO: 6384 - DNA, 20 bp, Artificial Sequence
  Description of Artificial Sequence: Synthetic oligonucleotide
aggatgggaaaactgaggcc

SEQ ID NO: 6385 - DNA, 20 bp, Artificial Sequence
  Description of Artificial Sequence: Synthetic oligonucleotide
ggatgggaaaactgaggcca

SEQ ID NO: 6386 - DNA, 20 bp, Artificial Sequence
  Description of Artificial Sequence: Synthetic oligonucleotide
gatgggaaaactgaggccag

SEQ ID NO: 6387 - DNA, 20 bp, Artificial Sequence
  Description of Artificial Sequence: Synthetic oligonucleotide
atgggaaaactgaggccaga

SEQ ID NO: 6388 - DNA, 20 bp, Artificial Sequence
  Description of Artificial Sequence: Synthetic oligonucleotide
tgggaaaactgaggccagat

SEQ ID NO: 6389 - DNA, 20 bp, Artificial Sequence
  Description of Artificial Sequence: Synthetic oligonucleotide
gggaaaactgaggccagata

SEQ ID NO: 6390 - DNA, 20 bp, Artificial Sequence
  Description of Artificial Sequence: Synthetic oligonucleotide
ggaaaactgaggccagatag

SEQ ID NO: 6391 - DNA, 20 bp, Artificial Sequence
  Description of Artificial Sequence: Synthetic oligonucleotide
gaaaactgaggccagatagg

SEQ ID NO: 6392 - DNA, 20 bp, Artificial Sequence
  Description of Artificial Sequence: Synthetic oligonucleotide
aaaactgaggccagataggc

SEQ ID NO: 6393 - DNA, 20 bp, Artificial Sequence
  Description of Artificial Sequence: Synthetic oligonucleotide
aaactgaggccagataggct

SEQ ID NO: 6394 - DNA, 20 bp, Artificial Sequence
  Description of Artificial Sequence: Synthetic oligonucleotide
aactgaggccagataggcta

SEQ ID NO: 6395 - DNA, 20 bp, Artificial Sequence
  Description of Artificial Sequence: Synthetic oligonucleotide
actgaggccagataggctaa

SEQ ID NO: 6396 - DNA, 20 bp, Artificial Sequence
  Description of Artificial Sequence: Synthetic oligonucleotide
ctgaggccagataggctaag

SEQ ID NO: 6397 - DNA, 20 bp, Artificial Sequence
  Description of Artificial Sequence: Synthetic oligonucleotide
tgaggccagataggctaagt

SEQ ID NO: 6398 - DNA, 20 bp, Artificial Sequence
  Description of Artificial Sequence: Synthetic oligonucleotide
gaggccagataggctaagtt

SEQ ID NO: 6399 - DNA, 20 bp, Artificial Sequence
  Description of Artificial Sequence: Synthetic oligonucleotide
aggccagataggctaagtta

SEQ ID NO: 6400 - DNA, 20 bp, Artificial Sequence
  Description of Artificial Sequence: Synthetic oligonucleotide
ggccagataggctaagttag

SEQ ID NO: 6401 - DNA, 20 bp, Artificial Sequence
  Description of Artificial Sequence: Synthetic oligonucleotide
gccagataggctaagttagt

SEQ ID NO: 6402 - DNA, 20 bp, Artificial Sequence
  Description of Artificial Sequence: Synthetic oligonucleotide
ccagataggctaagttagtg

SEQ ID NO: 6403 - DNA, 20 bp, Artificial Sequence
  Description of Artificial Sequence: Synthetic oligonucleotide
cagataggctaagttagtgg

SEQ ID NO: 6404 - DNA, 20 bp, Artificial Sequence
  Description of Artificial Sequence: Synthetic oligonucleotide
agataggctaagttagtggc

SEQ ID NO: 6405 - DNA, 20 bp, Artificial Sequence
  Description of Artificial Sequence: Synthetic oligonucleotide
gataggctaagttagtggcc

SEQ ID NO: 6406 - DNA, 20 bp, Artificial Sequence
  Description of Artificial Sequence: Synthetic oligonucleotide
ataggctaagttagtggccc

SEQ ID NO: 6407 - DNA, 20 bp, Artificial Sequence
  Description of Artificial Sequence: Synthetic oligonucleotide
taggctaagttagtggccca

SEQ ID NO: 6408 - DNA, 20 bp, Artificial Sequence
  Description of Artificial Sequence: Synthetic oligonucleotide
aggctaagttagtggcccaa

SEQ ID NO: 6409 - DNA, 20 bp, Artificial Sequence
  Description of Artificial Sequence: Synthetic oligonucleotide
ggctaagttagtggcccaat

SEQ ID NO: 6410 - DNA, 20 bp, Artificial Sequence
  Description of Artificial Sequence: Synthetic oligonucleotide
gctaagttagtggcccaatc

SEQ ID NO: 6411 - DNA, 20 bp, Artificial Sequence
  Description of Artificial Sequence: Synthetic oligonucleotide
ctaagttagtggcccaatca

SEQ ID NO: 6412 - DNA, 20 bp, Artificial Sequence
  Description of Artificial Sequence: Synthetic oligonucleotide
taagttagtggcccaatcac

SEQ ID NO: 6413 - DNA, 20 bp, Artificial Sequence
  Description of Artificial Sequence: Synthetic oligonucleotide
aagttagtggcccaatcaca

SEQ ID NO: 6414 - DNA, 20 bp, Artificial Sequence
  Description of Artificial Sequence: Synthetic oligonucleotide
agttagtggcccaatcacac

SEQ ID NO: 6415 - DNA, 20 bp, Artificial Sequence
  Description of Artificial Sequence: Synthetic oligonucleotide
gttagtggcccaatcacaca

SEQ ID NO: 6416 - DNA, 20 bp, Artificial Sequence
  Description of Artificial Sequence: Synthetic oligonucleotide
ttagtggcccaatcacacac

SEQ ID NO: 6417 - DNA, 20 bp, Artificial Sequence
  Description of Artificial Sequence: Synthetic oligonucleotide
tagtggcccaatcacacaca

SEQ ID NO: 6418 - DNA, 20 bp, Artificial Sequence
  Description of Artificial Sequence: Synthetic oligonucleotide
agtggcccaatcacacacac

SEQ ID NO: 6419 - DNA, 20 bp, Artificial Sequence
  Description of Artificial Sequence: Synthetic oligonucleotide
gtggcccaatcacacacacg

SEQ ID NO: 6420 - DNA, 20 bp, Artificial Sequence
  Description of Artificial Sequence: Synthetic oligonucleotide
tggcccaatcacacacacgg

SEQ ID NO: 6421 - DNA, 20 bp, Artificial Sequence
  Description of Artificial Sequence: Synthetic oligonucleotide
ggcccaatcacacacacggc

SEQ ID NO: 6422 - DNA, 20 bp, Artificial Sequence
  Description of Artificial Sequence: Synthetic oligonucleotide
gcccaatcacacacacggca

SEQ ID NO: 6423 - DNA, 20 bp, Artificial Sequence
  Description of Artificial Sequence: Synthetic oligonucleotide
cccaatcacacacacggcat

SEQ ID NO: 6424 - DNA, 20 bp, Artificial Sequence
  Description of Artificial Sequence: Synthetic oligonucleotide
ccaatcacacacacggcatg

SEQ ID NO: 6425 - DNA, 20 bp, Artificial Sequence
  Description of Artificial Sequence: Synthetic oligonucleotide
caatcacacacacggcatgt

SEQ ID NO: 6426 - DNA, 20 bp, Artificial Sequence
  Description of Artificial Sequence: Synthetic oligonucleotide
aatcacacacacggcatgta

SEQ ID NO: 6427 - DNA, 20 bp, Artificial Sequence
  Description of Artificial Sequence: Synthetic oligonucleotide
atcacacacacggcatgtaa

SEQ ID NO: 6428 - DNA, 20 bp, Artificial Sequence
  Description of Artificial Sequence: Synthetic oligonucleotide
tcacacacacggcatgtaag

SEQ ID NO: 6429 - DNA, 20 bp, Artificial Sequence
  Description of Artificial Sequence: Synthetic oligonucleotide
cacacacacggcatgtaagg

SEQ ID NO: 6430 - DNA, 20 bp, Artificial Sequence
  Description of Artificial Sequence: Synthetic oligonucleotide
acacacacggcatgtaagga

SEQ ID NO: 6431 - DNA, 20 bp, Artificial Sequence
  Description of Artificial Sequence: Synthetic oligonucleotide
cacacacggcatgtaaggaa

SEQ ID NO: 6432 - DNA, 20 bp, Artificial Sequence
  Description of Artificial Sequence: Synthetic oligonucleotide
acacacggcatgtaaggaag

SEQ ID NO: 6433 - DNA, 20 bp, Artificial Sequence
  Description of Artificial Sequence: Synthetic oligonucleotide
cacacggcatgtaaggaaga

SEQ ID NO: 6434 - DNA, 20 bp, Artificial Sequence
  Description of Artificial Sequence: Synthetic oligonucleotide
acacggcatgtaaggaagag

SEQ ID NO: 6435 - DNA, 20 bp, Artificial Sequence
  Description of Artificial Sequence: Synthetic oligonucleotide
cacggcatgtaaggaagagg

SEQ ID NO: 6436 - DNA, 20 bp, Artificial Sequence
  Description of Artificial Sequence: Synthetic oligonucleotide
acggcatgtaaggaagaggt

SEQ ID NO: 6437 - DNA, 20 bp, Artificial Sequence
  Description of Artificial Sequence: Synthetic oligonucleotide
cggcatgtaaggaagaggtg

SEQ ID NO: 6438 - DNA, 20 bp, Artificial Sequence
  Description of Artificial Sequence: Synthetic oligonucleotide
ggcatgtaaggaagaggtgg

SEQ ID NO: 6439 - DNA, 20 bp, Artificial Sequence
  Description of Artificial Sequence: Synthetic oligonucleotide
gcatgtaaggaagaggtggg

SEQ ID NO: 6440 - DNA, 20 bp, Artificial Sequence
  Description of Artificial Sequence: Synthetic oligonucleotide
catgtaaggaagaggtgggg

SEQ ID NO: 6441 - DNA, 20 bp, Artificial Sequence
  Description of Artificial Sequence: Synthetic oligonucleotide
atgtaaggaagaggtggggg

SEQ ID NO: 6442 - DNA, 20 bp, Artificial Sequence
  Description of Artificial Sequence: Synthetic oligonucleotide
tgtaaggaagaggtgggggc

SEQ ID NO: 6443 - DNA, 20 bp, Artificial Sequence
  Description of Artificial Sequence: Synthetic oligonucleotide
gtaaggaagaggtgggggca

SEQ ID NO: 6444 - DNA, 20 bp, Artificial Sequence
  Description of Artificial Sequence: Synthetic oligonucleotide
taaggaagaggtgggggcag

SEQ ID NO: 6445 - DNA, 20 bp, Artificial Sequence
  Description of Artificial Sequence: Synthetic oligonucleotide
aaggaagaggtgggggcagg

SEQ ID NO: 6446 - DNA, 20 bp, Artificial Sequence
  Description of Artificial Sequence: Synthetic oligonucleotide
aggaagaggtgggggcagga

SEQ ID NO: 6447 - DNA, 20 bp, Artificial Sequence
  Description of Artificial Sequence: Synthetic oligonucleotide
ggaagaggtgggggcaggaa

SEQ ID NO: 6448 - DNA, 20 bp, Artificial Sequence
  Description of Artificial Sequence: Synthetic oligonucleotide
gaagaggtgggggcaggaaa

SEQ ID NO: 6449 - DNA, 20 bp, Artificial Sequence
  Description of Artificial Sequence: Synthetic oligonucleotide
aagaggtgggggcaggaaac

SEQ ID NO: 6450 - DNA, 20 bp, Artificial Sequence
  Description of Artificial Sequence: Synthetic oligonucleotide
agaggtgggggcaggaaaca

SEQ ID NO: 6451 - DNA, 20 bp, Artificial Sequence
  Description of Artificial Sequence: Synthetic oligonucleotide
gaggtgggggcaggaaacag

SEQ ID NO: 6452 - DNA, 20 bp, Artificial Sequence
  Description of Artificial Sequence: Synthetic oligonucleotide
aggtgggggcaggaaacaga

SEQ ID NO: 6453 - DNA, 20 bp, Artificial Sequence
  Description of Artificial Sequence: Synthetic oligonucleotide
ggtgggggcaggaaacagat

SEQ ID NO: 6454 - DNA, 20 bp, Artificial Sequence
  Description of Artificial Sequence: Synthetic oligonucleotide
gtgggggcaggaaacagatg

SEQ ID NO: 6455 - DNA, 20 bp, Artificial Sequence
  Description of Artificial Sequence: Synthetic oligonucleotide
tgggggcaggaaacagatgc

SEQ ID NO: 6456 - DNA, 20 bp, Artificial Sequence
  Description of Artificial Sequence: Synthetic oligonucleotide
gggggcaggaaacagatgca

SEQ ID NO: 6457 - DNA, 20 bp, Artificial Sequence
  Description of Artificial Sequence: Synthetic oligonucleotide
ggggcaggaaacagatgcaa

SEQ ID NO: 6458 - DNA, 20 bp, Artificial Sequence
  Description of Artificial Sequence: Synthetic oligonucleotide
gggcaggaaacagatgcaat

SEQ ID NO: 6459 - DNA, 20 bp, Artificial Sequence
  Description of Artificial Sequence: Synthetic oligonucleotide
ggcaggaaacagatgcaatg

SEQ ID NO: 6460 - DNA, 20 bp, Artificial Sequence
  Description of Artificial Sequence: Synthetic oligonucleotide
gcaggaaacagatgcaatgt

SEQ ID NO: 6461 - DNA, 20 bp, Artificial Sequence
  Description of Artificial Sequence: Synthetic oligonucleotide
caggaaacagatgcaatgtg

SEQ ID NO: 6462 - DNA, 20 bp, Artificial Sequence
  Description of Artificial Sequence: Synthetic oligonucleotide
aggaaacagatgcaatgtgg

SEQ ID NO: 6463 - DNA, 20 bp, Artificial Sequence
  Description of Artificial Sequence: Synthetic oligonucleotide
ggaaacagatgcaatgtggg

SEQ ID NO: 6464 - DNA, 20 bp, Artificial Sequence
  Description of Artificial Sequence: Synthetic oligonucleotide
gaaacagatgcaatgtgggg

SEQ ID NO: 6465 - DNA, 20 bp, Artificial Sequence
  Description of Artificial Sequence: Synthetic oligonucleotide
aaacagatgcaatgtggggt

SEQ ID NO: 6466 - DNA, 20 bp, Artificial Sequence
  Description of Artificial Sequence: Synthetic oligonucleotide
aacagatgcaatgtggggtt

SEQ ID NO: 6467 - DNA, 20 bp, Artificial Sequence
  Description of Artificial Sequence: Synthetic oligonucleotide
acagatgcaatgtggggttg

SEQ ID NO: 6468 - DNA, 20 bp, Artificial Sequence
  Description of Artificial Sequence: Synthetic oligonucleotide
cagatgcaatgtggggttga

SEQ ID NO: 6469 - DNA, 20 bp, Artificial Sequence
  Description of Artificial Sequence: Synthetic oligonucleotide
agatgcaatgtggggttgaa

SEQ ID NO: 6470 - DNA, 20 bp, Artificial Sequence
  Description of Artificial Sequence: Synthetic oligonucleotide
gatgcaatgtggggttgaag

SEQ ID NO: 6471 - DNA, 20 bp, Artificial Sequence
  Description of Artificial Sequence: Synthetic oligonucleotide
atgcaatgtggggttgaagg

SEQ ID NO: 6472 - DNA, 20 bp, Artificial Sequence
  Description of Artificial Sequence: Synthetic oligonucleotide
tgcaatgtggggttgaaggc

SEQ ID NO: 6473 - DNA, 20 bp, Artificial Sequence
  Description of Artificial Sequence: Synthetic oligonucleotide
gcaatgtggggttgaaggca

SEQ ID NO: 6474 - DNA, 20 bp, Artificial Sequence
  Description of Artificial Sequence: Synthetic oligonucleotide
caatgtggggttgaaggcag

SEQ ID NO: 6475 - DNA, 20 bp, Artificial Sequence
  Description of Artificial Sequence: Synthetic oligonucleotide
aatgtggggttgaaggcagg

SEQ ID NO: 6476 - DNA, 20 bp, Artificial Sequence
  Description of Artificial Sequence: Synthetic oligonucleotide
atgtggggttgaaggcagga

SEQ ID NO: 6477 - DNA, 20 bp, Artificial Sequence
  Description of Artificial Sequence: Synthetic oligonucleotide
tgtggggttgaaggcaggac

SEQ ID NO: 6478 - DNA, 20 bp, Artificial Sequence
  Description of Artificial Sequence: Synthetic oligonucleotide
gtggggttgaaggcaggaca

SEQ ID NO: 6479 - DNA, 20 bp, Artificial Sequence
  Description of Artificial Sequence: Synthetic oligonucleotide
tggggttgaaggcaggacag

SEQ ID NO: 6480 - DNA, 20 bp, Artificial Sequence
  Description of Artificial Sequence: Synthetic oligonucleotide
ggggttgaaggcaggacaga

SEQ ID NO: 6481 - DNA, 20 bp, Artificial Sequence
  Description of Artificial Sequence: Synthetic oligonucleotide
gggttgaaggcaggacagag

SEQ ID NO: 6482 - DNA, 20 bp, Artificial Sequence
  Description of Artificial Sequence: Synthetic oligonucleotide
ggttgaaggcaggacagagc

SEQ ID NO: 6483 - DNA, 20 bp, Artificial Sequence
  Description of Artificial Sequence: Synthetic oligonucleotide
gttgaaggcaggacagagca

SEQ ID NO: 6484 - DNA, 20 bp, Artificial Sequence
  Description of Artificial Sequence: Synthetic oligonucleotide
ttgaaggcaggacagagcag

SEQ ID NO: 6485 - DNA, 20 bp, Artificial Sequence
  Description of Artificial Sequence: Synthetic oligonucleotide
tgaaggcaggacagagcagc

SEQ ID NO: 6486 - DNA, 20 bp, Artificial Sequence
  Description of Artificial Sequence: Synthetic oligonucleotide
gaaggcaggacagagcagca

SEQ ID NO: 6487 - DNA, 20 bp, Artificial Sequence
  Description of Artificial Sequence: Synthetic oligonucleotide
aaggcaggacagagcagcag

SEQ ID NO: 6488 - DNA, 20 bp, Artificial Sequence
  Description of Artificial Sequence: Synthetic oligonucleotide
aggcaggacagagcagcaga

SEQ ID NO: 6489 - DNA, 20 bp, Artificial Sequence
  Description of Artificial Sequence: Synthetic oligonucleotide
ggcaggacagagcagcagaa

SEQ ID NO: 6490 - DNA, 20 bp, Artificial Sequence
  Description of Artificial Sequence: Synthetic oligonucleotide
gcaggacagagcagcagaaa

SEQ ID NO: 6491 - DNA, 20 bp, Artificial Sequence
  Description of Artificial Sequence: Synthetic oligonucleotide
caggacagagcagcagaaag

SEQ ID NO: 6492 - DNA, 20 bp, Artificial Sequence
  Description of Artificial Sequence: Synthetic oligonucleotide
aggacagagcagcagaaaga

SEQ ID NO: 6493 - DNA, 20 bp, Artificial Sequence
  Description of Artificial Sequence: Synthetic oligonucleotide
ggacagagcagcagaaagat

SEQ ID NO: 6494 - DNA, 20 bp, Artificial Sequence
  Description of Artificial Sequence: Synthetic oligonucleotide
gacagagcagcagaaagata

SEQ ID NO: 6495 - DNA, 20 bp, Artificial Sequence
  Description of Artificial Sequence: Synthetic oligonucleotide
acagagcagcagaaagataa

SEQ ID NO: 6496 - DNA, 20 bp, Artificial Sequence
  Description of Artificial Sequence: Synthetic oligonucleotide
cagagcagcagaaagataag

SEQ ID NO: 6497 - DNA, 20 bp, Artificial Sequence
  Description of Artificial Sequence: Synthetic oligonucleotide
agagcagcagaaagataagg

SEQ ID NO: 6498 - DNA, 20 bp, Artificial Sequence
  Description of Artificial Sequence: Synthetic oligonucleotide
gagcagcagaaagataagga

SEQ ID NO: 6499 - DNA, 20 bp, Artificial Sequence
  Description of Artificial Sequence: Synthetic oligonucleotide
agcagcagaaagataaggag

SEQ ID NO: 6500 - DNA, 20 bp, Artificial Sequence
  Description of Artificial Sequence: Synthetic oligonucleotide
gcagcagaaagataaggagg

SEQ ID NO: 6501 - DNA, 20 bp, Artificial Sequence
  Description of Artificial Sequence: Synthetic oligonucleotide
cagcagaaagataaggaggg

SEQ ID NO: 6502 - DNA, 20 bp, Artificial Sequence
  Description of Artificial Sequence: Synthetic oligonucleotide
agcagaaagataaggaggga

SEQ ID NO: 6503 - DNA, 20 bp, Artificial Sequence
  Description of Artificial Sequence: Synthetic oligonucleotide
gcagaaagataaggagggaa

SEQ ID NO: 6504 - DNA, 20 bp, Artificial Sequence
  Description of Artificial Sequence: Synthetic oligonucleotide
cagaaagataaggagggaag

SEQ ID NO: 6505 - DNA, 20 bp, Artificial Sequence
  Description of Artificial Sequence: Synthetic oligonucleotide
agaaagataaggagggaagc

SEQ ID NO: 6506 - DNA, 20 bp, Artificial Sequence
  Description of Artificial Sequence: Synthetic oligonucleotide
gaaagataaggagggaagct

SEQ ID NO: 6507 - DNA, 20 bp, Artificial Sequence
  Description of Artificial Sequence: Synthetic oligonucleotide
aaagataaggagggaagctg

SEQ ID NO: 6508 - DNA, 20 bp, Artificial Sequence
  Description of Artificial Sequence: Synthetic oligonucleotide
aagataaggagggaagctgc

SEQ ID NO: 6509 - DNA, 20 bp, Artificial Sequence
  Description of Artificial Sequence: Synthetic oligonucleotide
agataaggagggaagctgct

SEQ ID NO: 6510 - DNA, 20 bp, Artificial Sequence
  Description of Artificial Sequence: Synthetic oligonucleotide
gataaggagggaagctgctg

SEQ ID NO: 6511 - DNA, 20 bp, Artificial Sequence
  Description of Artificial Sequence: Synthetic oligonucleotide
ataaggagggaagctgctgg

SEQ ID NO: 6512 - DNA, 20 bp, Artificial Sequence
  Description of Artificial Sequence: Synthetic oligonucleotide
taaggagggaagctgctggc

SEQ ID NO: 6513 - DNA, 20 bp, Artificial Sequence
  Description of Artificial Sequence: Synthetic oligonucleotide
aaggagggaagctgctggct

SEQ ID NO: 6514 - DNA, 20 bp, Artificial Sequence
  Description of Artificial Sequence: Synthetic oligonucleotide
aggagggaagctgctggctg

SEQ ID NO: 6515 - DNA, 20 bp, Artificial Sequence
  Description of Artificial Sequence: Synthetic oligonucleotide
ggagggaagctgctggctgg

SEQ ID NO: 6516 - DNA, 20 bp, Artificial Sequence
  Description of Artificial Sequence: Synthetic oligonucleotide
gagggaagctgctggctggg

SEQ ID NO: 6517 - DNA, 20 bp, Artificial Sequence
  Description of Artificial Sequence: Synthetic oligonucleotide
agggaagctgctggctgggt

SEQ ID NO: 6518 - DNA, 20 bp, Artificial Sequence
  Description of Artificial Sequence: Synthetic oligonucleotide
gggaagctgctggctgggtg

SEQ ID NO: 6519 - DNA, 20 bp, Artificial Sequence
  Description of Artificial Sequence: Synthetic oligonucleotide
ggaagctgctggctgggtgt

SEQ ID NO: 6520 - DNA, 20 bp, Artificial Sequence
  Description of Artificial Sequence: Synthetic oligonucleotide
gaagctgctggctgggtgtg

SEQ ID NO: 6521 - DNA, 20 bp, Artificial Sequence
  Description of Artificial Sequence: Synthetic oligonucleotide
aagctgctggctgggtgtgg

SEQ ID NO: 6522 - DNA, 20 bp, Artificial Sequence
  Description of Artificial Sequence: Synthetic oligonucleotide
agctgctggctgggtgtggc

SEQ ID NO: 6523 - DNA, 20 bp, Artificial Sequence
  Description of Artificial Sequence: Synthetic oligonucleotide
gctgctggctgggtgtggca

SEQ ID NO: 6524 - DNA, 20 bp, Artificial Sequence
  Description of Artificial Sequence: Synthetic oligonucleotide
ctgctggctgggtgtggcat

SEQ ID NO: 6525 - DNA, 20 bp, Artificial Sequence
  Description of Artificial Sequence: Synthetic oligonucleotide
tgctggctgggtgtggcatg

SEQ ID NO: 6526 - DNA, 20 bp, Artificial Sequence
  Description of Artificial Sequence: Synthetic oligonucleotide
gctggctgggtgtggcatgg

SEQ ID NO: 6527 - DNA, 20 bp, Artificial Sequence
  Description of Artificial Sequence: Synthetic oligonucleotide
ctggctgggtgtggcatggc

SEQ ID NO: 6528 - DNA, 20 bp, Artificial Sequence
  Description of Artificial Sequence: Synthetic oligonucleotide
tggctgggtgtggcatggca

SEQ ID NO: 6529 - DNA, 20 bp, Artificial Sequence
  Description of Artificial Sequence: Synthetic oligonucleotide
ggctgggtgtggcatggcag

SEQ ID NO: 6530 - DNA, 20 bp, Artificial Sequence
  Description of Artificial Sequence: Synthetic oligonucleotide
gctgggtgtggcatggcagg

SEQ ID NO: 6531 - DNA, 20 bp, Artificial Sequence
  Description of Artificial Sequence: Synthetic oligonucleotide
ctgggtgtggcatggcaggg

SEQ ID NO: 6532 - DNA, 20 bp, Artificial Sequence
  Description of Artificial Sequence: Synthetic oligonucleotide
tgggtgtggcatggcagggc

SEQ ID NO: 6533 - DNA, 20 bp, Artificial Sequence
  Description of Artificial Sequence: Synthetic oligonucleotide
gggtgtggcatggcagggcc

SEQ ID NO: 6534 - DNA, 20 bp, Artificial Sequence
  Description of Artificial Sequence: Synthetic oligonucleotide
ggtgtggcatggcagggcct

SEQ ID NO: 6535 - DNA, 20 bp, Artificial Sequence
  Description of Artificial Sequence: Synthetic oligonucleotide
gtgtggcatggcagggcctg

SEQ ID NO: 6536 - DNA, 20 bp, Artificial Sequence
  Description of Artificial Sequence: Synthetic oligonucleotide
tgtggcatggcagggcctgc

SEQ ID NO: 6537 - DNA, 20 bp, Artificial Sequence
  Description of Artificial Sequence: Synthetic oligonucleotide
gtggcatggcagggcctgct

SEQ ID NO: 6538 - DNA, 20 bp, Artificial Sequence
  Description of Artificial Sequence: Synthetic oligonucleotide
tggcatggcagggcctgctc

SEQ ID NO: 6539 - DNA, 20 bp, Artificial Sequence
  Description of Artificial Sequence: Synthetic oligonucleotide
ggcatggcagggcctgctca

SEQ ID NO: 6540 - DNA, 20 bp, Artificial Sequence
  Description of Artificial Sequence: Synthetic oligonucleotide
gcatggcagggcctgctcac

SEQ ID NO: 6541 - DNA, 20 bp, Artificial Sequence
  Description of Artificial Sequence: Synthetic oligonucleotide
catggcagggcctgctcacc

SEQ ID NO: 6542 - DNA, 20 bp, Artificial Sequence
  Description of Artificial Sequence: Synthetic oligonucleotide
atggcagggcctgctcacca

SEQ ID NO: 6543 - DNA, 20 bp, Artificial Sequence
  Description of Artificial Sequence: Synthetic oligonucleotide
tggcagggcctgctcaccag

SEQ ID NO: 6544 - DNA, 20 bp, Artificial Sequence
  Description of Artificial Sequence: Synthetic oligonucleotide
ggcagggcctgctcaccaga

SEQ ID NO: 6545 - DNA, 20 bp, Artificial Sequence
  Description of Artificial Sequence: Synthetic oligonucleotide
gcagggcctgctcaccagag

SEQ ID NO: 6546 - DNA, 20 bp, Artificial Sequence
  Description of Artificial Sequence: Synthetic oligonucleotide
cagggcctgctcaccagaga

SEQ ID NO: 6547 - DNA, 20 bp, Artificial Sequence
  Description of Artificial Sequence: Synthetic oligonucleotide
agggcctgctcaccagagag

SEQ ID NO: 6548 - DNA, 20 bp, Artificial Sequence
  Description of Artificial Sequence: Synthetic oligonucleotide
gggcctgctcaccagagagg

SEQ ID NO: 6549 - DNA, 20 bp, Artificial Sequence
  Description of Artificial Sequence: Synthetic oligonucleotide
ggcctgctcaccagagaggc

SEQ ID NO: 6550 - DNA, 20 bp, Artificial Sequence
  Description of Artificial Sequence: Synthetic oligonucleotide
gcctgctcaccagagaggct

SEQ ID NO: 6551 - DNA, 20 bp, Artificial Sequence
  Description of Artificial Sequence: Synthetic oligonucleotide
cctgctcaccagagaggctc

SEQ ID NO: 6552 - DNA, 20 bp, Artificial Sequence
  Description of Artificial Sequence: Synthetic oligonucleotide
ctgctcaccagagaggctct

SEQ ID NO: 6553 - DNA, 20 bp, Artificial Sequence
  Description of Artificial Sequence: Synthetic oligonucleotide
tgctcaccagagaggctctt

SEQ ID NO: 6554 - DNA, 20 bp, Artificial Sequence
  Description of Artificial Sequence: Synthetic oligonucleotide
gctcaccagagaggctcttg

SEQ ID NO: 6555 - DNA, 20 bp, Artificial Sequence
  Description of Artificial Sequence: Synthetic oligonucleotide
ctcaccagagaggctcttgg

SEQ ID NO: 6556 - DNA, 20 bp, Artificial Sequence
  Description of Artificial Sequence: Synthetic oligonucleotide
tcaccagagaggctcttggc

SEQ ID NO: 6557 - DNA, 20 bp, Artificial Sequence
  Description of Artificial Sequence: Synthetic oligonucleotide
caccagagaggctcttggcg

SEQ ID NO: 6558 - DNA, 20 bp, Artificial Sequence
  Description of Artificial Sequence: Synthetic oligonucleotide
accagagaggctcttggcgc

SEQ ID NO: 6559 - DNA, 20 bp, Artificial Sequence
  Description of Artificial Sequence: Synthetic oligonucleotide
ccagagaggctcttggcgca

SEQ ID NO: 6560 - DNA, 20 bp, Artificial Sequence
  Description of Artificial Sequence: Synthetic oligonucleotide
cagagaggctcttggcgcag

SEQ ID NO: 6561 - DNA, 20 bp, Artificial Sequence
  Description of Artificial Sequence: Synthetic oligonucleotide
agagaggctcttggcgcagt

SEQ ID NO: 6562 - DNA, 20 bp, Artificial Sequence
  Description of Artificial Sequence: Synthetic oligonucleotide
gagaggctcttggcgcagtt

SEQ ID NO: 6563 - DNA, 20 bp, Artificial Sequence
  Description of Artificial Sequence: Synthetic oligonucleotide
agaggctcttggcgcagttc

SEQ ID NO: 6564 - DNA, 20 bp, Artificial Sequence
  Description of Artificial Sequence: Synthetic oligonucleotide
gaggctcttggcgcagttct

SEQ ID NO: 6565 - DNA, 20 bp, Artificial Sequence
  Description of Artificial Sequence: Synthetic oligonucleotide
aggctcttggcgcagttctt

SEQ ID NO: 6566 - DNA, 20 bp, Artificial Sequence
  Description of Artificial Sequence: Synthetic oligonucleotide
ggctcttggcgcagttcttg

SEQ ID NO: 6567 - DNA, 20 bp, Artificial Sequence
  Description of Artificial Sequence: Synthetic oligonucleotide
gctcttggcgcagttcttgt

SEQ ID NO: 6568 - DNA, 20 bp, Artificial Sequence
  Description of Artificial Sequence: Synthetic oligonucleotide
ctcttggcgcagttcttgtc

SEQ ID NO: 6569 - DNA, 20 bp, Artificial Sequence
  Description of Artificial Sequence: Synthetic oligonucleotide
tcttggcgcagttcttgtcc

SEQ ID NO: 6570 - DNA, 20 bp, Artificial Sequence
  Description of Artificial Sequence: Synthetic oligonucleotide
cttggcgcagttcttgtccc

SEQ ID NO: 6571 - DNA, 20 bp, Artificial Sequence
  Description of Artificial Sequence: Synthetic oligonucleotide
ttggcgcagttcttgtccct

SEQ ID NO: 6572 - DNA, 20 bp, Artificial Sequence
  Description of Artificial Sequence: Synthetic oligonucleotide
tggcgcagttcttgtccctg

SEQ ID NO: 6573 - DNA, 20 bp, Artificial Sequence
  Description of Artificial Sequence: Synthetic oligonucleotide
ggcgcagttcttgtccctgc

SEQ ID NO: 6574 - DNA, 20 bp, Artificial Sequence
  Description of Artificial Sequence: Synthetic oligonucleotide
gcgcagttcttgtccctgcg

SEQ ID NO: 6575 - DNA, 20 bp, Artificial Sequence
  Description of Artificial Sequence: Synthetic oligonucleotide
cgcagttcttgtccctgcgg

SEQ ID NO: 6576 - DNA, 20 bp, Artificial Sequence
  Description of Artificial Sequence: Synthetic oligonucleotide
gcagttcttgtccctgcgga

SEQ ID NO: 6577 - DNA, 20 bp, Artificial Sequence
  Description of Artificial Sequence: Synthetic oligonucleotide
cagttcttgtccctgcggag

SEQ ID NO: 6578 - DNA, 20 bp, Artificial Sequence
  Description of Artificial Sequence: Synthetic oligonucleotide
agttcttgtccctgcggagg

SEQ ID NO: 6579 - DNA, 20 bp, Artificial Sequence
  Description of Artificial Sequence: Synthetic oligonucleotide
gttcttgtccctgcggaggt

SEQ ID NO: 6580 - DNA, 20 bp, Artificial Sequence
  Description of Artificial Sequence: Synthetic oligonucleotide
ttcttgtccctgcggaggtc

SEQ ID NO: 6581 - DNA, 20 bp, Artificial Sequence
  Description of Artificial Sequence: Synthetic oligonucleotide
tcttgtccctgcggaggtcg

SEQ ID NO: 6582 - DNA, 20 bp, Artificial Sequence
  Description of Artificial Sequence: Synthetic oligonucleotide
cttgtccctgcggaggtcgt

SEQ ID NO: 6583 - DNA, 20 bp, Artificial Sequence
  Description of Artificial Sequence: Synthetic oligonucleotide
ttgtccctgcggaggtcgtg

SEQ ID NO: 6584 - DNA, 20 bp, Artificial Sequence
  Description of Artificial Sequence: Synthetic oligonucleotide
tgtccctgcggaggtcgtga

SEQ ID NO: 6585 - DNA, 20 bp, Artificial Sequence
  Description of Artificial Sequence: Synthetic oligonucleotide
gtccctgcggaggtcgtgat

SEQ ID NO: 6586 - DNA, 20 bp, Artificial Sequence
  Description of Artificial Sequence: Synthetic oligonucleotide
tccctgcggaggtcgtgatc

SEQ ID NO: 6587 - DNA, 20 bp, Artificial Sequence
  Description of Artificial Sequence: Synthetic oligonucleotide
ccctgcggaggtcgtgatcc

SEQ ID NO: 6588 - DNA, 20 bp, Artificial Sequence
  Description of Artificial Sequence: Synthetic oligonucleotide
cctgcggaggtcgtgatcct

SEQ ID NO: 6589 - DNA, 20 bp, Artificial Sequence
  Description of Artificial Sequence: Synthetic oligonucleotide
ctgcggaggtcgtgatcctg

SEQ ID NO: 6590 - DNA, 20 bp, Artificial Sequence
  Description of Artificial Sequence: Synthetic oligonucleotide
tgcggaggtcgtgatcctgg

SEQ ID NO: 6591 - DNA, 20 bp, Artificial Sequence
  Description of Artificial Sequence: Synthetic oligonucleotide
gcggaggtcgtgatcctggt

SEQ ID NO: 6592 - DNA, 20 bp, Artificial Sequence
  Description of Artificial Sequence: Synthetic oligonucleotide
cggaggtcgtgatcctggtc

SEQ ID NO: 6593 - DNA, 20 bp, Artificial Sequence
  Description of Artificial Sequence: Synthetic oligonucleotide
ggaggtcgtgatcctggtcc

SEQ ID NO: 6594 - DNA, 20 bp, Artificial Sequence
  Description of Artificial Sequence: Synthetic oligonucleotide
gaggtcgtgatcctggtccc

SEQ ID NO: 6595 - DNA, 20 bp, Artificial Sequence
  Description of Artificial Sequence: Synthetic oligonucleotide
aggtcgtgatcctggtccca

SEQ ID NO: 6596 - DNA, 20 bp, Artificial Sequence
  Description of Artificial Sequence: Synthetic oligonucleotide
ggtcgtgatcctggtcccaa

SEQ ID NO: 6597 - DNA, 20 bp, Artificial Sequence
  Description of Artificial Sequence: Synthetic oligonucleotide
gtcgtgatcctggtcccaag

SEQ ID NO: 6598 - DNA, 20 bp, Artificial Sequence
  Description of Artificial Sequence: Synthetic oligonucleotide
tcgtgatcctggtcccaagt

SEQ ID NO: 6599 - DNA, 20 bp, Artificial Sequence
  Description of Artificial Sequence: Synthetic oligonucleotide
cgtgatcctggtcccaagtg

SEQ ID NO: 6600 - DNA, 20 bp, Artificial Sequence
  Description of Artificial Sequence: Synthetic oligonucleotide
gtgatcctggtcccaagtgg

SEQ ID NO: 6601 - DNA, 20 bp, Artificial Sequence
  Description of Artificial Sequence: Synthetic oligonucleotide
tgatcctggtcccaagtgga

SEQ ID NO: 6602 - DNA, 20 bp, Artificial Sequence
  Description of Artificial Sequence: Synthetic oligonucleotide
gatcctggtcccaagtggag

SEQ ID NO: 6603 - DNA, 20 bp, Artificial Sequence
  Description of Artificial Sequence: Synthetic oligonucleotide
atcctggtcccaagtggaga

SEQ ID NO: 6604 - DNA, 20 bp, Artificial Sequence
  Description of Artificial Sequence: Synthetic oligonucleotide
tcctggtcccaagtggagaa

SEQ ID NO: 6605 - DNA, 20 bp, Artificial Sequence
  Description of Artificial Sequence: Synthetic oligonucleotide
cctggtcccaagtggagaag

SEQ ID NO: 6606 - DNA, 20 bp, Artificial Sequence
  Description of Artificial Sequence: Synthetic oligonucleotide
ctggtcccaagtggagaagg

SEQ ID NO: 6607 - DNA, 20 bp, Artificial Sequence
  Description of Artificial Sequence: Synthetic oligonucleotide
tggtcccaagtggagaaggg

SEQ ID NO: 6608 - DNA, 20 bp, Artificial Sequence
  Description of Artificial Sequence: Synthetic oligonucleotide
ggtcccaagtggagaagggt

SEQ ID NO: 6609 - DNA, 20 bp, Artificial Sequence
  Description of Artificial Sequence: Synthetic oligonucleotide
gtcccaagtggagaagggta

SEQ ID NO: 6610 - DNA, 20 bp, Artificial Sequence
  Description of Artificial Sequence: Synthetic oligonucleotide
tcccaagtggagaagggtac

SEQ ID NO: 6611 - DNA, 20 bp, Artificial Sequence
  Description of Artificial Sequence: Synthetic oligonucleotide
cccaagtggagaagggtacg

SEQ ID NO: 6612 - DNA, 20 bp, Artificial Sequence
  Description of Artificial Sequence: Synthetic oligonucleotide
ccaagtggagaagggtacgg

SEQ ID NO: 6613 - DNA, 20 bp, Artificial Sequence
  Description of Artificial Sequence: Synthetic oligonucleotide
caagtggagaagggtacgga

SEQ ID NO: 6614 - DNA, 20 bp, Artificial Sequence
  Description of Artificial Sequence: Synthetic oligonucleotide
aagtggagaagggtacggag

SEQ ID NO: 6615 - DNA, 20 bp, Artificial Sequence
  Description of Artificial Sequence: Synthetic oligonucleotide
agtggagaagggtacggaga

SEQ ID NO: 6616 - DNA, 20 bp, Artificial Sequence
  Description of Artificial Sequence: Synthetic oligonucleotide
gtggagaagggtacggagag

SEQ ID NO: 6617 - DNA, 20 bp, Artificial Sequence
  Description of Artificial Sequence: Synthetic oligonucleotide
tggagaagggtacggagagg

SEQ ID NO: 6618 - DNA, 20 bp, Artificial Sequence
  Description of Artificial Sequence: Synthetic oligonucleotide
ggagaagggtacggagaggc

SEQ ID NO: 6619 - DNA, 20 bp, Artificial Sequence
  Description of Artificial Sequence: Synthetic oligonucleotide
gagaagggtacggagaggcc

SEQ ID NO: 6620 - DNA, 20 bp, Artificial Sequence
  Description of Artificial Sequence: Synthetic oligonucleotide
agaagggtacggagaggccg

SEQ ID NO: 6621 - DNA, 20 bp, Artificial Sequence
  Description of Artificial Sequence: Synthetic oligonucleotide
gaagggtacggagaggccgc

SEQ ID NO: 6622 - DNA, 20 bp, Artificial Sequence
  Description of Artificial Sequence: Synthetic oligonucleotide
aagggtacggagaggccgct

SEQ ID NO: 6623 - DNA, 20 bp, Artificial Sequence
  Description of Artificial Sequence: Synthetic oligonucleotide
agggtacggagaggccgctg

SEQ ID NO: 6624 - DNA, 20 bp, Artificial Sequence
  Description of Artificial Sequence: Synthetic oligonucleotide
gggtacggagaggccgctgg

SEQ ID NO: 6625 - DNA, 20 bp, Artificial Sequence
  Description of Artificial Sequence: Synthetic oligonucleotide
ggtacggagaggccgctggg

SEQ ID NO: 6626 - DNA, 20 bp, Artificial Sequence
  Description of Artificial Sequence: Synthetic oligonucleotide
gtacggagaggccgctgggt

SEQ ID NO: 6627 - DNA, 20 bp, Artificial Sequence
  Description of Artificial Sequence: Synthetic oligonucleotide
tacggagaggccgctgggtg

SEQ ID NO: 6628 - DNA, 20 bp, Artificial Sequence
  Description of Artificial Sequence: Synthetic oligonucleotide
acggagaggccgctgggtgg

SEQ ID NO: 6629 - DNA, 20 bp, Artificial Sequence
  Description of Artificial Sequence: Synthetic oligonucleotide
cggagaggccgctgggtggg

SEQ ID NO: 6630 - DNA, 20 bp, Artificial Sequence
  Description of Artificial Sequence: Synthetic oligonucleotide
ggagaggccgctgggtggga

SEQ ID NO: 6631 - DNA, 20 bp, Artificial Sequence
  Description of Artificial Sequence: Synthetic oligonucleotide
gagaggccgctgggtgggac

SEQ ID NO: 6632 - DNA, 20 bp, Artificial Sequence
  Description of Artificial Sequence: Synthetic oligonucleotide
agaggccgctgggtgggacg

SEQ ID NO: 6633 - DNA, 20 bp, Artificial Sequence
  Description of Artificial Sequence: Synthetic oligonucleotide
gaggccgctgggtgggacgg

SEQ ID NO: 6634 - DNA, 20 bp, Artificial Sequence
  Description of Artificial Sequence: Synthetic oligonucleotide
aggccgctgggtgggacggt

SEQ ID NO: 6635 - DNA, 20 bp, Artificial Sequence
  Description of Artificial Sequence: Synthetic oligonucleotide
ggccgctgggtgggacggtg

SEQ ID NO: 6636 - DNA, 20 bp, Artificial Sequence
  Description of Artificial Sequence: Synthetic oligonucleotide
gccgctgggtgggacggtgg

SEQ ID NO: 6637 - DNA, 20 bp, Artificial Sequence
  Description of Artificial Sequence: Synthetic oligonucleotide
ccgctgggtgggacggtggt

SEQ ID NO: 6638 - DNA, 20 bp, Artificial Sequence
  Description of Artificial Sequence: Synthetic oligonucleotide
cgctgggtgggacggtggtg

SEQ ID NO: 6639 - DNA, 20 bp, Artificial Sequence
  Description of Artificial Sequence: Synthetic oligonucleotide
gctgggtgggacggtggtgg

SEQ ID NO: 6640 - DNA, 20 bp, Artificial Sequence
  Description of Artificial Sequence: Synthetic oligonucleotide
ctgggtgggacggtggtggc

SEQ ID NO: 6641 - DNA, 20 bp, Artificial Sequence
  Description of Artificial Sequence: Synthetic oligonucleotide
tgggtgggacggtggtggcg

SEQ ID NO: 6642 - DNA, 20 bp, Artificial Sequence
  Description of Artificial Sequence: Synthetic oligonucleotide
gggtgggacggtggtggcgc

SEQ ID NO: 6643 - DNA, 20 bp, Artificial Sequence
  Description of Artificial Sequence: Synthetic oligonucleotide
ggtgggacggtggtggcgcc

SEQ ID NO: 6644 - DNA, 20 bp, Artificial Sequence
  Description of Artificial Sequence: Synthetic oligonucleotide
gtgggacggtggtggcgccc

SEQ ID NO: 6645 - DNA, 20 bp, Artificial Sequence
  Description of Artificial Sequence: Synthetic oligonucleotide
tgggacggtggtggcgccca

SEQ ID NO: 6646 - DNA, 20 bp, Artificial Sequence
  Description of Artificial Sequence: Synthetic oligonucleotide
gggacggtggtggcgcccag

SEQ ID NO: 6647 - DNA, 20 bp, Artificial Sequence
  Description of Artificial Sequence: Synthetic oligonucleotide
ggacggtggtggcgcccagc

SEQ ID NO: 6648 - DNA, 20 bp, Artificial Sequence
  Description of Artificial Sequence: Synthetic oligonucleotide
gacggtggtggcgcccagct

SEQ ID NO: 6649 - DNA, 20 bp, Artificial Sequence
  Description of Artificial Sequence: Synthetic oligonucleotide
acggtggtggcgcccagctg

SEQ ID NO: 6650 - DNA, 20 bp, Artificial Sequence
  Description of Artificial Sequence: Synthetic oligonucleotide
cggtggtggcgcccagctgg

SEQ ID NO: 6651 - DNA, 20 bp, Artificial Sequence
  Description of Artificial Sequence: Synthetic oligonucleotide
ggtggtggcgcccagctggc

SEQ ID NO: 6652 - DNA, 20 bp, Artificial Sequence
  Description of Artificial Sequence: Synthetic oligonucleotide
gtggtggcgcccagctggcc

SEQ ID NO: 6653 - DNA, 20 bp, Artificial Sequence
  Description of Artificial Sequence: Synthetic oligonucleotide
tggtggcgcccagctggccg

SEQ ID NO: 6654 - DNA, 20 bp, Artificial Sequence
  Description of Artificial Sequence: Synthetic oligonucleotide
ggtggcgcccagctggccgg

SEQ ID NO: 6655 - DNA, 20 bp, Artificial Sequence
  Description of Artificial Sequence: Synthetic oligonucleotide
gtggcgcccagctggccggc

SEQ ID NO: 6656 - DNA, 20 bp, Artificial Sequence
  Description of Artificial Sequence: Synthetic oligonucleotide
tggcgcccagctggccggcc

SEQ ID NO: 6657 - DNA, 20 bp, Artificial Sequence
  Description of Artificial Sequence: Synthetic oligonucleotide
ggcgcccagctggccggcca

SEQ ID NO: 6658 - DNA, 20 bp, Artificial Sequence
  Description of Artificial Sequence: Synthetic oligonucleotide
gcgcccagctggccggccac

SEQ ID NO: 6659 - DNA, 20 bp, Artificial Sequence
  Description of Artificial Sequence: Synthetic oligonucleotide
cgcccagctggccggccacg

SEQ ID NO: 6660 - DNA, 20 bp, Artificial Sequence
  Description of Artificial Sequence: Synthetic oligonucleotide
gcccagctggccggccacgg

SEQ ID NO: 6661 - DNA, 20 bp, Artificial Sequence
  Description of Artificial Sequence: Synthetic oligonucleotide
cccagctggccggccacggg

SEQ ID NO: 6662 - DNA, 20 bp, Artificial Sequence
  Description of Artificial Sequence: Synthetic oligonucleotide
ccagctggccggccacgggt

SEQ ID NO: 6663 - DNA, 20 bp, Artificial Sequence
  Description of Artificial Sequence: Synthetic oligonucleotide
cagctggccggccacgggtg

SEQ ID NO: 6664 - DNA, 20 bp, Artificial Sequence
  Description of Artificial Sequence: Synthetic oligonucleotide
agctggccggccacgggtgc

SEQ ID NO: 6665 - DNA, 20 bp, Artificial Sequence
  Description of Artificial Sequence: Synthetic oligonucleotide
gctggccggccacgggtgca

SEQ ID NO: 6666 - DNA, 20 bp, Artificial Sequence
  Description of Artificial Sequence: Synthetic oligonucleotide
ctggccggccacgggtgcag

SEQ ID NO: 6667 - DNA, 20 bp, Artificial Sequence
  Description of Artificial Sequence: Synthetic oligonucleotide
tggccggccacgggtgcagt

SEQ ID NO: 6668 - DNA, 20 bp, Artificial Sequence
  Description of Artificial Sequence: Synthetic oligonucleotide
ggccggccacgggtgcagtg

SEQ ID NO: 6669 - DNA, 20 bp, Artificial Sequence
  Description of Artificial Sequence: Synthetic oligonucleotide
gccggccacgggtgcagtga

SEQ ID NO: 6670 - DNA, 20 bp, Artificial Sequence
  Description of Artificial Sequence: Synthetic oligonucleotide
ccggccacgggtgcagtgag

SEQ ID NO: 6671 - DNA, 20 bp, Artificial Sequence
  Description of Artificial Sequence: Synthetic oligonucleotide
cggccacgggtgcagtgagc

SEQ ID NO: 6672 - DNA, 20 bp, Artificial Sequence
  Description of Artificial Sequence: Synthetic oligonucleotide
ggccacgggtgcagtgagct

SEQ ID NO: 6673 - DNA, 20 bp, Artificial Sequence
  Description of Artificial Sequence: Synthetic oligonucleotide
gccacgggtgcagtgagctg

SEQ ID NO: 6674 - DNA, 20 bp, Artificial Sequence
  Description of Artificial Sequence: Synthetic oligonucleotide
ccacgggtgcagtgagctgc

SEQ ID NO: 6675 - DNA, 20 bp, Artificial Sequence
  Description of Artificial Sequence: Synthetic oligonucleotide
cacgggtgcagtgagctgca

SEQ ID NO: 6676 - DNA, 20 bp, Artificial Sequence
  Description of Artificial Sequence: Synthetic oligonucleotide
acgggtgcagtgagctgcag

SEQ ID NO: 6677 - DNA, 20 bp, Artificial Sequence
  Description of Artificial Sequence: Synthetic oligonucleotide
cgggtgcagtgagctgcagg

SEQ ID NO: 6678 - DNA, 20 bp, Artificial Sequence
  Description of Artificial Sequence: Synthetic oligonucleotide
gggtgcagtgagctgcaggc

SEQ ID NO: 6679 - DNA, 20 bp, Artificial Sequence
  Description of Artificial Sequence: Synthetic oligonucleotide
ggtgcagtgagctgcaggct

SEQ ID NO: 6680 - DNA, 20 bp, Artificial Sequence
  Description of Artificial Sequence: Synthetic oligonucleotide
gtgcagtgagctgcaggcta

SEQ ID NO: 6681 - DNA, 20 bp, Artificial Sequence
  Description of Artificial Sequence: Synthetic oligonucleotide
tgcagtgagctgcaggctat

SEQ ID NO: 6682 - DNA, 20 bp, Artificial Sequence
  Description of Artificial Sequence: Synthetic oligonucleotide
gcagtgagctgcaggctata

SEQ ID NO: 6683 - DNA, 20 bp, Artificial Sequence
  Description of Artificial Sequence: Synthetic oligonucleotide
cagtgagctgcaggctatag

SEQ ID NO: 6684 - DNA, 20 bp, Artificial Sequence
  Description of Artificial Sequence: Synthetic oligonucleotide
agtgagctgcaggctatagg

SEQ ID NO: 6685 - DNA, 20 bp, Artificial Sequence
  Description of Artificial Sequence: Synthetic oligonucleotide
gtgagctgcaggctataggc

SEQ ID NO: 6686 - DNA, 20 bp, Artificial Sequence
  Description of Artificial Sequence: Synthetic oligonucleotide
tgagctgcaggctataggcc

SEQ ID NO: 6687 - DNA, 20 bp, Artificial Sequence
  Description of Artificial Sequence: Synthetic oligonucleotide
gagctgcaggctataggccg

SEQ ID NO: 6688 - DNA, 20 bp, Artificial Sequence
  Description of Artificial Sequence: Synthetic oligonucleotide
agctgcaggctataggccgt

SEQ ID NO: 6689 - DNA, 20 bp, Artificial Sequence
  Description of Artificial Sequence: Synthetic oligonucleotide
gctgcaggctataggccgtg

SEQ ID NO: 6690 - DNA, 20 bp, Artificial Sequence
  Description of Artificial Sequence: Synthetic oligonucleotide
ctgcaggctataggccgtgt

SEQ ID NO: 6691 - DNA, 20 bp, Artificial Sequence
  Description of Artificial Sequence: Synthetic oligonucleotide
tgcaggctataggccgtgtc

SEQ ID NO: 6692 - DNA, 20 bp, Artificial Sequence
  Description of Artificial Sequence: Synthetic oligonucleotide
gcaggctataggccgtgtcc

SEQ ID NO: 6693 - DNA, 20 bp, Artificial Sequence
  Description of Artificial Sequence: Synthetic oligonucleotide
caggctataggccgtgtcct

SEQ ID NO: 6694 - DNA, 20 bp, Artificial Sequence
  Description of Artificial Sequence: Synthetic oligonucleotide
aggctataggccgtgtcctc

SEQ ID NO: 6695 - DNA, 20 bp, Artificial Sequence
  Description of Artificial Sequence: Synthetic oligonucleotide
ggctataggccgtgtcctcg

SEQ ID NO: 6696 - DNA, 20 bp, Artificial Sequence
  Description of Artificial Sequence: Synthetic oligonucleotide
gctataggccgtgtcctcgc

SEQ ID NO: 6697 - DNA, 20 bp, Artificial Sequence
  Description of Artificial Sequence: Synthetic oligonucleotide
ctataggccgtgtcctcgcc

SEQ ID NO: 6698 - DNA, 20 bp, Artificial Sequence
  Description of Artificial Sequence: Synthetic oligonucleotide
tataggccgtgtcctcgcca

SEQ ID NO: 6699 - DNA, 20 bp, Artificial Sequence
  Description of Artificial Sequence: Synthetic oligonucleotide
ataggccgtgtcctcgccac

SEQ ID NO: 6700 - DNA, 20 bp, Artificial Sequence
  Description of Artificial Sequence: Synthetic oligonucleotide
taggccgtgtcctcgccacc

SEQ ID NO: 6701 - DNA, 20 bp, Artificial Sequence
  Description of Artificial Sequence: Synthetic oligonucleotide
aggccgtgtcctcgccaccc

SEQ ID NO: 6702 - DNA, 20 bp, Artificial Sequence
  Description of Artificial Sequence: Synthetic oligonucleotide
ggccgtgtcctcgccaccca

SEQ ID NO: 6703 - DNA, 20 bp, Artificial Sequence
  Description of Artificial Sequence: Synthetic oligonucleotide
gccgtgtcctcgccacccag

SEQ ID NO: 6704 - DNA, 20 bp, Artificial Sequence
  Description of Artificial Sequence: Synthetic oligonucleotide
ccgtgtcctcgccacccagg

SEQ ID NO: 6705 - DNA, 20 bp, Artificial Sequence
  Description of Artificial Sequence: Synthetic oligonucleotide
cgtgtcctcgccacccaggt

SEQ ID NO: 6706 - DNA, 20 bp, Artificial Sequence
  Description of Artificial Sequence: Synthetic oligonucleotide
gtgtcctcgccacccaggtg

SEQ ID NO: 6707 - DNA, 20 bp, Artificial Sequence
  Description of Artificial Sequence: Synthetic oligonucleotide
tgtcctcgccacccaggtgc

SEQ ID NO: 6708 - DNA, 20 bp, Artificial Sequence
  Description of Artificial Sequence: Synthetic oligonucleotide
gtcctcgccacccaggtgca

SEQ ID NO: 6709 - DNA, 20 bp, Artificial Sequence
  Description of Artificial Sequence: Synthetic oligonucleotide
tcctcgccacccaggtgcac

SEQ ID NO: 6710 - DNA, 20 bp, Artificial Sequence
  Description of Artificial Sequence: Synthetic oligonucleotide
cctcgccacccaggtgcacg

SEQ ID NO: 6711 - DNA, 20 bp, Artificial Sequence
  Description of Artificial Sequence: Synthetic oligonucleotide
ctcgccacccaggtgcacgg

SEQ ID NO: 6712 - DNA, 20 bp, Artificial Sequence
  Description of Artificial Sequence: Synthetic oligonucleotide
tcgccacccaggtgcacgga

SEQ ID NO: 6713 - DNA, 20 bp, Artificial Sequence
  Description of Artificial Sequence: Synthetic oligonucleotide
cgccacccaggtgcacggag

SEQ ID NO: 6714 - DNA, 20 bp, Artificial Sequence
  Description of Artificial Sequence: Synthetic oligonucleotide
gccacccaggtgcacggaga

SEQ ID NO: 6715 - DNA, 20 bp, Artificial Sequence
  Description of Artificial Sequence: Synthetic oligonucleotide
ccacccaggtgcacggagaa

SEQ ID NO: 6716 - DNA, 20 bp, Artificial Sequence
  Description of Artificial Sequence: Synthetic oligonucleotide
cacccaggtgcacggagaac

SEQ ID NO: 6717 - DNA, 20 bp, Artificial Sequence
  Description of Artificial Sequence: Synthetic oligonucleotide
acccaggtgcacggagaact

SEQ ID NO: 6718 - DNA, 20 bp, Artificial Sequence
  Description of Artificial Sequence: Synthetic oligonucleotide
cccaggtgcacggagaactg

SEQ ID NO: 6719 - DNA, 20 bp, Artificial Sequence
  Description of Artificial Sequence: Synthetic oligonucleotide
ccaggtgcacggagaactgc

SEQ ID NO: 6720 - DNA, 20 bp, Artificial Sequence
  Description of Artificial Sequence: Synthetic oligonucleotide
caggtgcacggagaactgca

SEQ ID NO: 6721 - DNA, 20 bp, Artificial Sequence
  Description of Artificial Sequence: Synthetic oligonucleotide
aggtgcacggagaactgcag

SEQ ID NO: 6722 - DNA, 20 bp, Artificial Sequence
  Description of Artificial Sequence: Synthetic oligonucleotide
ggtgcacggagaactgcagc

SEQ ID NO: 6723 - DNA, 20 bp, Artificial Sequence
  Description of Artificial Sequence: Synthetic oligonucleotide
gtgcacggagaactgcagca

SEQ ID NO: 6724 - DNA, 20 bp, Artificial Sequence
  Description of Artificial Sequence: Synthetic oligonucleotide
tgcacggagaactgcagcaa

SEQ ID NO: 6725 - DNA, 20 bp, Artificial Sequence
  Description of Artificial Sequence: Synthetic oligonucleotide
gcacggagaactgcagcaac

SEQ ID NO: 6726 - DNA, 20 bp, Artificial Sequence
  Description of Artificial Sequence: Synthetic oligonucleotide
cacggagaactgcagcaact

SEQ ID NO: 6727 - DNA, 20 bp, Artificial Sequence
  Description of Artificial Sequence: Synthetic oligonucleotide
acggagaactgcagcaactc

SEQ ID NO: 6728 - DNA, 20 bp, Artificial Sequence
  Description of Artificial Sequence: Synthetic oligonucleotide
cggagaactgcagcaactcg

SEQ ID NO: 6729 - DNA, 20 bp, Artificial Sequence
  Description of Artificial Sequence: Synthetic oligonucleotide
ggagaactgcagcaactcgg

SEQ ID NO: 6730 - DNA, 20 bp, Artificial Sequence
  Description of Artificial Sequence: Synthetic oligonucleotide
gagaactgcagcaactcggc

SEQ ID NO: 6731 - DNA, 20 bp, Artificial Sequence
  Description of Artificial Sequence: Synthetic oligonucleotide
agaactgcagcaactcggcg

SEQ ID NO: 6732 - DNA, 20 bp, Artificial Sequence
  Description of Artificial Sequence: Synthetic oligonucleotide
gaactgcagcaactcggcgt

SEQ ID NO: 6733 - DNA, 20 bp, Artificial Sequence
  Description of Artificial Sequence: Synthetic oligonucleotide
aactgcagcaactcggcgtt

SEQ ID NO: 6734 - DNA, 20 bp, Artificial Sequence
  Description of Artificial Sequence: Synthetic oligonucleotide
actgcagcaactcggcgttg

SEQ ID NO: 6735 - DNA, 20 bp, Artificial Sequence
  Description of Artificial Sequence: Synthetic oligonucleotide
ctgcagcaactcggcgttgc

SEQ ID NO: 6736 - DNA, 20 bp, Artificial Sequence
  Description of Artificial Sequence: Synthetic oligonucleotide
tgcagcaactcggcgttgcc

SEQ ID NO: 6737 - DNA, 20 bp, Artificial Sequence
  Description of Artificial Sequence: Synthetic oligonucleotide
gcagcaactcggcgttgcca

SEQ ID NO: 6738 - DNA, 20 bp, Artificial Sequence
  Description of Artificial Sequence: Synthetic oligonucleotide
cagcaactcggcgttgccat

SEQ ID NO: 6739 - DNA, 20 bp, Artificial Sequence
  Description of Artificial Sequence: Synthetic oligonucleotide
agcaactcggcgttgccatc

SEQ ID NO: 6740 - DNA, 20 bp, Artificial Sequence
  Description of Artificial Sequence: Synthetic oligonucleotide
gcaactcggcgttgccatcc

SEQ ID NO: 6741 - DNA, 20 bp, Artificial Sequence
  Description of Artificial Sequence: Synthetic oligonucleotide
caactcggcgttgccatccc

SEQ ID NO: 6742 - DNA, 20 bp, Artificial Sequence
  Description of Artificial Sequence: Synthetic oligonucleotide
aactcggcgttgccatccca

SEQ ID NO: 6743 - DNA, 20 bp, Artificial Sequence
  Description of Artificial Sequence: Synthetic oligonucleotide
actcggcgttgccatcccag

SEQ ID NO: 6744 - DNA, 20 bp, Artificial Sequence
  Description of Artificial Sequence: Synthetic oligonucleotide
ctcggcgttgccatcccagt

SEQ ID NO: 6745 - DNA, 20 bp, Artificial Sequence
  Description of Artificial Sequence: Synthetic oligonucleotide
tcggcgttgccatcccagtc

SEQ ID NO: 6746 - DNA, 20 bp, Artificial Sequence
  Description of Artificial Sequence: Synthetic oligonucleotide
cggcgttgccatcccagtcc

SEQ ID NO: 6747 - DNA, 20 bp, Artificial Sequence
  Description of Artificial Sequence: Synthetic oligonucleotide
ggcgttgccatcccagtccc

SEQ ID NO: 6748 - DNA, 20 bp, Artificial Sequence
  Description of Artificial Sequence: Synthetic oligonucleotide
gcgttgccatcccagtcccg

SEQ ID NO: 6749 - DNA, 20 bp, Artificial Sequence
  Description of Artificial Sequence: Synthetic oligonucleotide
cgttgccatcccagtcccgc

SEQ ID NO: 6750 - DNA, 20 bp, Artificial Sequence
  Description of Artificial Sequence: Synthetic oligonucleotide
gttgccatcccagtcccgca

SEQ ID NO: 6751 - DNA, 20 bp, Artificial Sequence
  Description of Artificial Sequence: Synthetic oligonucleotide
ttgccatcccagtcccgcag

SEQ ID NO: 6752 - DNA, 20 bp, Artificial Sequence
  Description of Artificial Sequence: Synthetic oligonucleotide
tgccatcccagtcccgcagc

SEQ ID NO: 6753 - DNA, 20 bp, Artificial Sequence
  Description of Artificial Sequence: Synthetic oligonucleotide
gccatcccagtcccgcagct

SEQ ID NO: 6754 - DNA, 20 bp, Artificial Sequence
  Description of Artificial Sequence: Synthetic oligonucleotide
ccatcccagtcccgcagctg

SEQ ID NO: 6755 - DNA, 20 bp, Artificial Sequence
  Description of Artificial Sequence: Synthetic oligonucleotide
catcccagtcccgcagctgc

SEQ ID NO: 6756 - DNA, 20 bp, Artificial Sequence
  Description of Artificial Sequence: Synthetic oligonucleotide
atcccagtcccgcagctgca

SEQ ID NO: 6757 - DNA, 20 bp, Artificial Sequence
  Description of Artificial Sequence: Synthetic oligonucleotide
tcccagtcccgcagctgcac

SEQ ID NO: 6758 - DNA, 20 bp, Artificial Sequence
  Description of Artificial Sequence: Synthetic oligonucleotide
cccagtcccgcagctgcacg

SEQ ID NO: 6759 - DNA, 20 bp, Artificial Sequence
  Description of Artificial Sequence: Synthetic oligonucleotide
ccagtcccgcagctgcacgg

SEQ ID NO: 6760 - DNA, 20 bp, Artificial Sequence
  Description of Artificial Sequence: Synthetic oligonucleotide
cagtcccgcagctgcacggc

SEQ ID NO: 6761 - DNA, 20 bp, Artificial Sequence
  Description of Artificial Sequence: Synthetic oligonucleotide
agtcccgcagctgcacggcc

SEQ ID NO: 6762 - DNA, 20 bp, Artificial Sequence
  Description of Artificial Sequence: Synthetic oligonucleotide
gtcccgcagctgcacggcca

SEQ ID NO: 6763 - DNA, 20 bp, Artificial Sequence
  Description of Artificial Sequence: Synthetic oligonucleotide
tcccgcagctgcacggccag

SEQ ID NO: 6764 - DNA, 20 bp, Artificial Sequence
  Description of Artificial Sequence: Synthetic oligonucleotide
cccgcagctgcacggccagg

SEQ ID NO: 6765 - DNA, 20 bp, Artificial Sequence
  Description of Artificial Sequence: Synthetic oligonucleotide
ccgcagctgcacggccaggc

SEQ ID NO: 6766 - DNA, 20 bp, Artificial Sequence
  Description of Artificial Sequence: Synthetic oligonucleotide
cgcagctgcacggccaggcg

SEQ ID NO: 6767 - DNA, 20 bp, Artificial Sequence
  Description of Artificial Sequence: Synthetic oligonucleotide
gcagctgcacggccaggcgg

SEQ ID NO: 6768 - DNA, 20 bp, Artificial Sequence
  Description of Artificial Sequence: Synthetic oligonucleotide
cagctgcacggccaggcggc

SEQ ID NO: 6769 - DNA, 20 bp, Artificial Sequence
  Description of Artificial Sequence: Synthetic oligonucleotide
agctgcacggccaggcggct

SEQ ID NO: 6770 - DNA, 20 bp, Artificial Sequence
  Description of Artificial Sequence: Synthetic oligonucleotide
gctgcacggccaggcggctg

SEQ ID NO: 6771 - DNA, 20 bp, Artificial Sequence
  Description of Artificial Sequence: Synthetic oligonucleotide
ctgcacggccaggcggctgt

SEQ ID NO: 6772 - DNA, 20 bp, Artificial Sequence
  Description of Artificial Sequence: Synthetic oligonucleotide
tgcacggccaggcggctgtt

SEQ ID NO: 6773 - DNA, 20 bp, Artificial Sequence
  Description of Artificial Sequence: Synthetic oligonucleotide
gcacggccaggcggctgttg

SEQ ID NO: 6774 - DNA, 20 bp, Artificial Sequence
  Description of Artificial Sequence: Synthetic oligonucleotide
cacggccaggcggctgttgc

SEQ ID NO: 6775 - DNA, 20 bp, Artificial Sequence
  Description of Artificial Sequence: Synthetic oligonucleotide
acggccaggcggctgttgcg

SEQ ID NO: 6776 - DNA, 20 bp, Artificial Sequence
  Description of Artificial Sequence: Synthetic oligonucleotide
cggccaggcggctgttgcgg

SEQ ID NO: 6777 - DNA, 20 bp, Artificial Sequence
  Description of Artificial Sequence: Synthetic oligonucleotide
ggccaggcggctgttgcggt

SEQ ID NO: 6778 - DNA, 20 bp, Artificial Sequence
  Description of Artificial Sequence: Synthetic oligonucleotide
gccaggcggctgttgcggtc

SEQ ID NO: 6779 - DNA, 20 bp, Artificial Sequence
  Description of Artificial Sequence: Synthetic oligonucleotide
ccaggcggctgttgcggtcc

SEQ ID NO: 6780 - DNA, 20 bp, Artificial Sequence
  Description of Artificial Sequence: Synthetic oligonucleotide
caggcggctgttgcggtccc

SEQ ID NO: 6781 - DNA, 20 bp, Artificial Sequence
  Description of Artificial Sequence: Synthetic oligonucleotide
aggcggctgttgcggtcccc

SEQ ID NO: 6782 - DNA, 20 bp, Artificial Sequence
  Description of Artificial Sequence: Synthetic oligonucleotide
ggcggctgttgcggtccccc

SEQ ID NO: 6783 - DNA, 20 bp, Artificial Sequence
  Description of Artificial Sequence: Synthetic oligonucleotide
gcggctgttgcggtcccccg

SEQ ID NO: 6784 - DNA, 20 bp, Artificial Sequence
  Description of Artificial Sequence: Synthetic oligonucleotide
cggctgttgcggtcccccgt

SEQ ID NO: 6785 - DNA, 20 bp, Artificial Sequence
  Description of Artificial Sequence: Synthetic oligonucleotide
ggctgttgcggtcccccgtg

SEQ ID NO: 6786 - DNA, 20 bp, Artificial Sequence
  Description of Artificial Sequence: Synthetic oligonucleotide
gctgttgcggtcccccgtga

SEQ ID NO: 6787 - DNA, 20 bp, Artificial Sequence
  Description of Artificial Sequence: Synthetic oligonucleotide
ctgttgcggtcccccgtgat

SEQ ID NO: 6788 - DNA, 20 bp, Artificial Sequence
  Description of Artificial Sequence: Synthetic oligonucleotide
tgttgcggtcccccgtgatg

SEQ ID NO: 6789 - DNA, 20 bp, Artificial Sequence
  Description of Artificial Sequence: Synthetic oligonucleotide
gttgcggtcccccgtgatgc

SEQ ID NO: 6790 - DNA, 20 bp, Artificial Sequence
  Description of Artificial Sequence: Synthetic oligonucleotide
ttgcggtcccccgtgatgct

SEQ ID NO: 6791 - DNA, 20 bp, Artificial Sequence
  Description of Artificial Sequence: Synthetic oligonucleotide
tgcggtcccccgtgatgcta

SEQ ID NO: 6792 - DNA, 20 bp, Artificial Sequence
  Description of Artificial Sequence: Synthetic oligonucleotide
gcggtcccccgtgatgctat

SEQ ID NO: 6793 - DNA, 20 bp, Artificial Sequence
  Description of Artificial Sequence: Synthetic oligonucleotide
cggtcccccgtgatgctatg

SEQ ID NO: 6794 - DNA, 20 bp, Artificial Sequence
  Description of Artificial Sequence: Synthetic oligonucleotide
ggtcccccgtgatgctatgc

SEQ ID NO: 6795 - DNA, 20 bp, Artificial Sequence
  Description of Artificial Sequence: Synthetic oligonucleotide
gtcccccgtgatgctatgca

SEQ ID NO: 6796 - DNA, 20 bp, Artificial Sequence
  Description of Artificial Sequence: Synthetic oligonucleotide
tcccccgtgatgctatgcac

SEQ ID NO: 6797 - DNA, 20 bp, Artificial Sequence
  Description of Artificial Sequence: Synthetic oligonucleotide
cccccgtgatgctatgcacc

SEQ ID NO: 6798 - DNA, 20 bp, Artificial Sequence
  Description of Artificial Sequence: Synthetic oligonucleotide
ccccgtgatgctatgcacct

SEQ ID NO: 6799 - DNA, 20 bp, Artificial Sequence
  Description of Artificial Sequence: Synthetic oligonucleotide
cccgtgatgctatgcacctt

SEQ ID NO: 6800 - DNA, 20 bp, Artificial Sequence
  Description of Artificial Sequence: Synthetic oligonucleotide
ccgtgatgctatgcaccttc

SEQ ID NO: 6801 - DNA, 20 bp, Artificial Sequence
  Description of Artificial Sequence: Synthetic oligonucleotide
cgtgatgctatgcaccttct

SEQ ID NO: 6802 - DNA, 20 bp, Artificial Sequence
  Description of Artificial Sequence: Synthetic oligonucleotide
gtgatgctatgcaccttctc

SEQ ID NO: 6803 - DNA, 20 bp, Artificial Sequence
  Description of Artificial Sequence: Synthetic oligonucleotide
tgatgctatgcaccttctcc

SEQ ID NO: 6804 - DNA, 20 bp, Artificial Sequence
  Description of Artificial Sequence: Synthetic oligonucleotide
gatgctatgcaccttctcca

SEQ ID NO: 6805 - DNA, 20 bp, Artificial Sequence
  Description of Artificial Sequence: Synthetic oligonucleotide
atgctatgcaccttctccag

SEQ ID NO: 6806 - DNA, 20 bp, Artificial Sequence
  Description of Artificial Sequence: Synthetic oligonucleotide
tgctatgcaccttctccaga

SEQ ID NO: 6807 - DNA, 20 bp, Artificial Sequence
  Description of Artificial Sequence: Synthetic oligonucleotide
gctatgcaccttctccagac

SEQ ID NO: 6808 - DNA, 20 bp, Artificial Sequence
  Description of Artificial Sequence: Synthetic oligonucleotide
ctatgcaccttctccagacc

SEQ ID NO: 6809 - DNA, 20 bp, Artificial Sequence
  Description of Artificial Sequence: Synthetic oligonucleotide
tatgcaccttctccagaccc

SEQ ID NO: 6810 - DNA, 20 bp, Artificial Sequence
  Description of Artificial Sequence: Synthetic oligonucleotide
atgcaccttctccagaccca

SEQ ID NO: 6811 - DNA, 20 bp, Artificial Sequence
  Description of Artificial Sequence: Synthetic oligonucleotide
tgcaccttctccagacccag

SEQ ID NO: 6812 - DNA, 20 bp, Artificial Sequence
  Description of Artificial Sequence: Synthetic oligonucleotide
gcaccttctccagacccagc

SEQ ID NO: 6813 - DNA, 20 bp, Artificial Sequence
  Description of Artificial Sequence: Synthetic oligonucleotide
caccttctccagacccagcc

SEQ ID NO: 6814 - DNA, 20 bp, Artificial Sequence
  Description of Artificial Sequence: Synthetic oligonucleotide
accttctccagacccagcca

SEQ ID NO: 6815 - DNA, 20 bp, Artificial Sequence
  Description of Artificial Sequence: Synthetic oligonucleotide
ccttctccagacccagccag

SEQ ID NO: 6816 - DNA, 20 bp, Artificial Sequence
  Description of Artificial Sequence: Synthetic oligonucleotide
cttctccagacccagccaga

SEQ ID NO: 6817 - DNA, 20 bp, Artificial Sequence
  Description of Artificial Sequence: Synthetic oligonucleotide
ttctccagacccagccagaa

SEQ ID NO: 6818 - DNA, 20 bp, Artificial Sequence
  Description of Artificial Sequence: Synthetic oligonucleotide
tctccagacccagccagaac

SEQ ID NO: 6819 - DNA, 20 bp, Artificial Sequence
  Description of Artificial Sequence: Synthetic oligonucleotide
ctccagacccagccagaact

SEQ ID NO: 6820 - DNA, 20 bp, Artificial Sequence
  Description of Artificial Sequence: Synthetic oligonucleotide
tccagacccagccagaactc

SEQ ID NO: 6821 - DNA, 20 bp, Artificial Sequence
  Description of Artificial Sequence: Synthetic oligonucleotide
ccagacccagccagaactcg

SEQ ID NO: 6822 - DNA, 20 bp, Artificial Sequence
  Description of Artificial Sequence: Synthetic oligonucleotide
cagacccagccagaactcgc

SEQ ID NO: 6823 - DNA, 20 bp, Artificial Sequence
  Description of Artificial Sequence: Synthetic oligonucleotide
agacccagccagaactcgcc

SEQ ID NO: 6824 - DNA, 20 bp, Artificial Sequence
  Description of Artificial Sequence: Synthetic oligonucleotide
gacccagccagaactcgcct

SEQ ID NO: 6825 - DNA, 20 bp, Artificial Sequence
  Description of Artificial Sequence: Synthetic oligonucleotide
acccagccagaactcgcctg

SEQ ID NO: 6826 - DNA, 20 bp, Artificial Sequence
  Description of Artificial Sequence: Synthetic oligonucleotide
cccagccagaactcgcctgg

SEQ ID NO: 6827 - DNA, 20 bp, Artificial Sequence
  Description of Artificial Sequence: Synthetic oligonucleotide
ccagccagaactcgcctgga

SEQ ID NO: 6828 - DNA, 20 bp, Artificial Sequence
  Description of Artificial Sequence: Synthetic oligonucleotide
cagccagaactcgcctggag

SEQ ID NO: 6829 - DNA, 20 bp, Artificial Sequence
  Description of Artificial Sequence: Synthetic oligonucleotide
agccagaactcgcctggagt

SEQ ID NO: 6830 - DNA, 20 bp, Artificial Sequence
  Description of Artificial Sequence: Synthetic oligonucleotide
gccagaactcgcctggagtg

SEQ ID NO: 6831 - DNA, 20 bp, Artificial Sequence
  Description of Artificial Sequence: Synthetic oligonucleotide
ccagaactcgcctggagtgg

SEQ ID NO: 6832 - DNA, 20 bp, Artificial Sequence
  Description of Artificial Sequence: Synthetic oligonucleotide
cagaactcgcctggagtggg

SEQ ID NO: 6833 - DNA, 20 bp, Artificial Sequence
  Description of Artificial Sequence: Synthetic oligonucleotide
agaactcgcctggagtggga

SEQ ID NO: 6834 - DNA, 20 bp, Artificial Sequence
  Description of Artificial Sequence: Synthetic oligonucleotide
gaactcgcctggagtgggag

SEQ ID NO: 6835 - DNA, 20 bp, Artificial Sequence
  Description of Artificial Sequence: Synthetic oligonucleotide
aactcgcctggagtgggaga

SEQ ID NO: 6836 - DNA, 20 bp, Artificial Sequence
  Description of Artificial Sequence: Synthetic oligonucleotide
actcgcctggagtgggagag

SEQ ID NO: 6837 - DNA, 20 bp, Artificial Sequence
  Description of Artificial Sequence: Synthetic oligonucleotide
ctcgcctggagtgggagagg

SEQ ID NO: 6838 - DNA, 20 bp, Artificial Sequence
  Description of Artificial Sequence: Synthetic oligonucleotide
tcgcctggagtgggagaggc

SEQ ID NO: 6839 - DNA, 20 bp, Artificial Sequence
  Description of Artificial Sequence: Synthetic oligonucleotide
cgcctggagtgggagaggcc

SEQ ID NO: 6840 - DNA, 20 bp, Artificial Sequence
  Description of Artificial Sequence: Synthetic oligonucleotide
gcctggagtgggagaggcca

SEQ ID NO: 6841 - DNA, 20 bp, Artificial Sequence
  Description of Artificial Sequence: Synthetic oligonucleotide
cctggagtgggagaggccac

SEQ ID NO: 6842 - DNA, 20 bp, Artificial Sequence
  Description of Artificial Sequence: Synthetic oligonucleotide
ctggagtgggagaggccact

SEQ ID NO: 6843 - DNA, 20 bp, Artificial Sequence
  Description of Artificial Sequence: Synthetic oligonucleotide
tggagtgggagaggccactc

SEQ ID NO: 6844 - DNA, 20 bp, Artificial Sequence
  Description of Artificial Sequence: Synthetic oligonucleotide
ggagtgggagaggccactcc

SEQ ID NO: 6845 - DNA, 20 bp, Artificial Sequence
  Description of Artificial Sequence: Synthetic oligonucleotide
gagtgggagaggccactcca

SEQ ID NO: 6846 - DNA, 20 bp, Artificial Sequence
  Description of Artificial Sequence: Synthetic oligonucleotide
agtgggagaggccactccat

SEQ ID NO: 6847 - DNA, 20 bp, Artificial Sequence
  Description of Artificial Sequence: Synthetic oligonucleotide
gtgggagaggccactccatg

SEQ ID NO: 6848 - DNA, 20 bp, Artificial Sequence
  Description of Artificial Sequence: Synthetic oligonucleotide
tgggagaggccactccatga

SEQ ID NO: 6849 - DNA, 20 bp, Artificial Sequence
  Description of Artificial Sequence: Synthetic oligonucleotide
gggagaggccactccatgag

SEQ ID NO: 6850 - DNA, 20 bp, Artificial Sequence
  Description of Artificial Sequence: Synthetic oligonucleotide
ggagaggccactccatgagg

SEQ ID NO: 6851 - DNA, 20 bp, Artificial Sequence
  Description of Artificial Sequence: Synthetic oligonucleotide
gagaggccactccatgaggc

SEQ ID NO: 6852 - DNA, 20 bp, Artificial Sequence
  Description of Artificial Sequence: Synthetic oligonucleotide
agaggccactccatgaggca

SEQ ID NO: 6853 - DNA, 20 bp, Artificial Sequence
  Description of Artificial Sequence: Synthetic oligonucleotide
gaggccactccatgaggcag

SEQ ID NO: 6854 - DNA, 20 bp, Artificial Sequence
  Description of Artificial Sequence: Synthetic oligonucleotide
aggccactccatgaggcagg

SEQ ID NO: 6855 - DNA, 20 bp, Artificial Sequence
  Description of Artificial Sequence: Synthetic oligonucleotide
ggccactccatgaggcaggg

SEQ ID NO: 6856 - DNA, 20 bp, Artificial Sequence
  Description of Artificial Sequence: Synthetic oligonucleotide
gccactccatgaggcagggc

SEQ ID NO: 6857 - DNA, 20 bp, Artificial Sequence
  Description of Artificial Sequence: Synthetic oligonucleotide
ccactccatgaggcagggcc

SEQ ID NO: 6858 - DNA, 20 bp, Artificial Sequence
  Description of Artificial Sequence: Synthetic oligonucleotide
cactccatgaggcagggcca

SEQ ID NO: 6859 - DNA, 20 bp, Artificial Sequence
  Description of Artificial Sequence: Synthetic oligonucleotide
actccatgaggcagggccac

SEQ ID NO: 6860 - DNA, 20 bp, Artificial Sequence
  Description of Artificial Sequence: Synthetic oligonucleotide
ctccatgaggcagggccact

SEQ ID NO: 6861 - DNA, 20 bp, Artificial Sequence
  Description of Artificial Sequence: Synthetic oligonucleotide
tccatgaggcagggccactt

SEQ ID NO: 6862 - DNA, 20 bp, Artificial Sequence
  Description of Artificial Sequence: Synthetic oligonucleotide
ccatgaggcagggccacttc

SEQ ID NO: 6863 - DNA, 20 bp, Artificial Sequence
  Description of Artificial Sequence: Synthetic oligonucleotide
catgaggcagggccacttct

SEQ ID NO: 6864 - DNA, 20 bp, Artificial Sequence
  Description of Artificial Sequence: Synthetic oligonucleotide
atgaggcagggccacttctg

SEQ ID NO: 6865 - DNA, 20 bp, Artificial Sequence
  Description of Artificial Sequence: Synthetic oligonucleotide
tgaggcagggccacttctga

SEQ ID NO: 6866 - DNA, 20 bp, Artificial Sequence
  Description of Artificial Sequence: Synthetic oligonucleotide
gaggcagggccacttctgag

SEQ ID NO: 6867 - DNA, 20 bp, Artificial Sequence
  Description of Artificial Sequence: Synthetic oligonucleotide
aggcagggccacttctgagg

SEQ ID NO: 6868 - DNA, 20 bp, Artificial Sequence
  Description of Artificial Sequence: Synthetic oligonucleotide
ggcagggccacttctgaggg

SEQ ID NO: 6869 - DNA, 20 bp, Artificial Sequence
  Description of Artificial Sequence: Synthetic oligonucleotide
gcagggccacttctgagggt

SEQ ID NO: 6870 - DNA, 20 bp, Artificial Sequence
  Description of Artificial Sequence: Synthetic oligonucleotide
cagggccacttctgagggtc

SEQ ID NO: 6871 - DNA, 20 bp, Artificial Sequence
  Description of Artificial Sequence: Synthetic oligonucleotide
agggccacttctgagggtcc

SEQ ID NO: 6872 - DNA, 20 bp, Artificial Sequence
  Description of Artificial Sequence: Synthetic oligonucleotide
gggccacttctgagggtccc

SEQ ID NO: 6873 - DNA, 20 bp, Artificial Sequence
  Description of Artificial Sequence: Synthetic oligonucleotide
ggccacttctgagggtccct

SEQ ID NO: 6874 - DNA, 20 bp, Artificial Sequence
  Description of Artificial Sequence: Synthetic oligonucleotide
gccacttctgagggtccctc

SEQ ID NO: 6875 - DNA, 20 bp, Artificial Sequence
  Description of Artificial Sequence: Synthetic oligonucleotide
ccacttctgagggtccctct

SEQ ID NO: 6876 - DNA, 20 bp, Artificial Sequence
  Description of Artificial Sequence: Synthetic oligonucleotide
cacttctgagggtccctctt

SEQ ID NO: 6877 - DNA, 20 bp, Artificial Sequence
  Description of Artificial Sequence: Synthetic oligonucleotide
acttctgagggtccctcttc

SEQ ID NO: 6878 - DNA, 20 bp, Artificial Sequence
  Description of Artificial Sequence: Synthetic oligonucleotide
cttctgagggtccctcttcc

SEQ ID NO: 6879 - DNA, 20 bp, Artificial Sequence
  Description of Artificial Sequence: Synthetic oligonucleotide
ttctgagggtccctcttcct

SEQ ID NO: 6880 - DNA, 20 bp, Artificial Sequence
  Description of Artificial Sequence: Synthetic oligonucleotide
tctgagggtccctcttcctc

SEQ ID NO: 6881 - DNA, 20 bp, Artificial Sequence
  Description of Artificial Sequence: Synthetic oligonucleotide
ctgagggtccctcttcctcc

SEQ ID NO: 6882 - DNA, 20 bp, Artificial Sequence
  Description of Artificial Sequence: Synthetic oligonucleotide
tgagggtccctcttcctccc

SEQ ID NO: 6883 - DNA, 20 bp, Artificial Sequence
  Description of Artificial Sequence: Synthetic oligonucleotide
gagggtccctcttcctcccc

SEQ ID NO: 6884 - DNA, 20 bp, Artificial Sequence
  Description of Artificial Sequence: Synthetic oligonucleotide
agggtccctcttcctcccct

SEQ ID NO: 6885 - DNA, 20 bp, Artificial Sequence
  Description of Artificial Sequence: Synthetic oligonucleotide
gggtccctcttcctcccctg

SEQ ID NO: 6886 - DNA, 20 bp, Artificial Sequence
  Description of Artificial Sequence: Synthetic oligonucleotide
ggtccctcttcctcccctgc

SEQ ID NO: 6887 - DNA, 20 bp, Artificial Sequence
  Description of Artificial Sequence: Synthetic oligonucleotide
gtccctcttcctcccctgcc

SEQ ID NO: 6888 - DNA, 20 bp, Artificial Sequence
  Description of Artificial Sequence: Synthetic oligonucleotide
tccctcttcctcccctgcct

SEQ ID NO: 6889 - DNA, 20 bp, Artificial Sequence
  Description of Artificial Sequence: Synthetic oligonucleotide
ccctcttcctcccctgcctc

SEQ ID NO: 6890 - DNA, 20 bp, Artificial Sequence
  Description of Artificial Sequence: Synthetic oligonucleotide
cctcttcctcccctgcctct

SEQ ID NO: 6891 - DNA, 20 bp, Artificial Sequence
  Description of Artificial Sequence: Synthetic oligonucleotide
ctcttcctcccctgcctctg

SEQ ID NO: 6892 - DNA, 20 bp, Artificial Sequence
  Description of Artificial Sequence: Synthetic oligonucleotide
tcttcctcccctgcctctgt

SEQ ID NO: 6893 - DNA, 20 bp, Artificial Sequence
  Description of Artificial Sequence: Synthetic oligonucleotide
cttcctcccctgcctctgtc

SEQ ID NO: 6894 - DNA, 20 bp, Artificial Sequence
  Description of Artificial Sequence: Synthetic oligonucleotide
ttcctcccctgcctctgtcc

SEQ ID NO: 6895 - DNA, 20 bp, Artificial Sequence
  Description of Artificial Sequence: Synthetic oligonucleotide
tcctcccctgcctctgtccc

SEQ ID NO: 6896 - DNA, 20 bp, Artificial Sequence
  Description of Artificial Sequence: Synthetic oligonucleotide
cctcccctgcctctgtcccc

SEQ ID NO: 6897 - DNA, 20 bp, Artificial Sequence
  Description of Artificial Sequence: Synthetic oligonucleotide
ctcccctgcctctgtcccca

SEQ ID NO: 6898 - DNA, 20 bp, Artificial Sequence
  Description of Artificial Sequence: Synthetic oligonucleotide
tcccctgcctctgtccccac

SEQ ID NO: 6899 - DNA, 20 bp, Artificial Sequence
  Description of Artificial Sequence: Synthetic oligonucleotide
cccctgcctctgtccccact

SEQ ID NO: 6900 - DNA, 20 bp, Artificial Sequence
  Description of Artificial Sequence: Synthetic oligonucleotide
ccctgcctctgtccccacta

SEQ ID NO: 6901 - DNA, 20 bp, Artificial Sequence
  Description of Artificial Sequence: Synthetic oligonucleotide
cctgcctctgtccccactag

SEQ ID NO: 6902 - DNA, 20 bp, Artificial Sequence
  Description of Artificial Sequence: Synthetic oligonucleotide
ctgcctctgtccccactaga

SEQ ID NO: 6903 - DNA, 20 bp, Artificial Sequence
  Description of Artificial Sequence: Synthetic oligonucleotide
tgcctctgtccccactagaa

SEQ ID NO: 6904 - DNA, 20 bp, Artificial Sequence
  Description of Artificial Sequence: Synthetic oligonucleotide
gcctctgtccccactagaaa

SEQ ID NO: 6905 - DNA, 20 bp, Artificial Sequence
  Description of Artificial Sequence: Synthetic oligonucleotide
cctctgtccccactagaaac

SEQ ID NO: 6906 - DNA, 20 bp, Artificial Sequence
  Description of Artificial Sequence: Synthetic oligonucleotide
ctctgtccccactagaaaca

SEQ ID NO: 6907 - DNA, 20 bp, Artificial Sequence
  Description of Artificial Sequence: Synthetic oligonucleotide
tctgtccccactagaaacac

SEQ ID NO: 6908 - DNA, 20 bp, Artificial Sequence
  Description of Artificial Sequence: Synthetic oligonucleotide
ctgtccccactagaaacacc

SEQ ID NO: 6909 - DNA, 20 bp, Artificial Sequence
  Description of Artificial Sequence: Synthetic oligonucleotide
tgtccccactagaaacacct

SEQ ID NO: 6910 - DNA, 20 bp, Artificial Sequence
  Description of Artificial Sequence: Synthetic oligonucleotide
gtccccactagaaacaccta

SEQ ID NO: 6911 - DNA, 20 bp, Artificial Sequence
  Description of Artificial Sequence: Synthetic oligonucleotide
tccccactagaaacacctac

SEQ ID NO: 6912 - DNA, 20 bp, Artificial Sequence
  Description of Artificial Sequence: Synthetic oligonucleotide
ccccactagaaacacctacc

SEQ ID NO: 6913 - DNA, 20 bp, Artificial Sequence
  Description of Artificial Sequence: Synthetic oligonucleotide
cccactagaaacacctaccg

SEQ ID NO: 6914 - DNA, 20 bp, Artificial Sequence
  Description of Artificial Sequence: Synthetic oligonucleotide
ccactagaaacacctaccgt

SEQ ID NO: 6915 - DNA, 20 bp, Artificial Sequence
  Description of Artificial Sequence: Synthetic oligonucleotide
cactagaaacacctaccgtg

SEQ ID NO: 6916 - DNA, 20 bp, Artificial Sequence
  Description of Artificial Sequence: Synthetic oligonucleotide
actagaaacacctaccgtgg

SEQ ID NO: 6917 - DNA, 20 bp, Artificial Sequence
  Description of Artificial Sequence: Synthetic oligonucleotide
ctagaaacacctaccgtggg

SEQ ID NO: 6918 - DNA, 20 bp, Artificial Sequence
  Description of Artificial Sequence: Synthetic oligonucleotide
tagaaacacctaccgtgggg

SEQ ID NO: 6919 - DNA, 20 bp, Artificial Sequence
  Description of Artificial Sequence: Synthetic oligonucleotide
agaaacacctaccgtgggga

SEQ ID NO: 6920 - DNA, 20 bp, Artificial Sequence
  Description of Artificial Sequence: Synthetic oligonucleotide
gaaacacctaccgtggggat

SEQ ID NO: 6921 - DNA, 20 bp, Artificial Sequence
  Description of Artificial Sequence: Synthetic oligonucleotide
aaacacctaccgtggggatc

SEQ ID NO: 6922 - DNA, 20 bp, Artificial Sequence
  Description of Artificial Sequence: Synthetic oligonucleotide
aacacctaccgtggggatcc

SEQ ID NO: 6923 - DNA, 20 bp, Artificial Sequence
  Description of Artificial Sequence: Synthetic oligonucleotide
acacctaccgtggggatccc

SEQ ID NO: 6924 - DNA, 20 bp, Artificial Sequence
  Description of Artificial Sequence: Synthetic oligonucleotide
cacctaccgtggggatcccc

SEQ ID NO: 6925 - DNA, 20 bp, Artificial Sequence
  Description of Artificial Sequence: Synthetic oligonucleotide
acctaccgtggggatcccca

SEQ ID NO: 6926 - DNA, 20 bp, Artificial Sequence
  Description of Artificial Sequence: Synthetic oligonucleotide
cctaccgtggggatccccaa

SEQ ID NO: 6927 - DNA, 20 bp, Artificial Sequence
  Description of Artificial Sequence: Synthetic oligonucleotide
ctaccgtggggatccccaaa

SEQ ID NO: 6928 - DNA, 20 bp, Artificial Sequence
  Description of Artificial Sequence: Synthetic oligonucleotide
taccgtggggatccccaaac

SEQ ID NO: 6929 - DNA, 20 bp, Artificial Sequence
  Description of Artificial Sequence: Synthetic oligonucleotide
accgtggggatccccaaacc

SEQ ID NO: 6930 - DNA, 20 bp, Artificial Sequence
  Description of Artificial Sequence: Synthetic oligonucleotide
ccgtggggatccccaaaccc

SEQ ID NO: 6931 - DNA, 20 bp, Artificial Sequence
  Description of Artificial Sequence: Synthetic oligonucleotide
cgtggggatccccaaacccc

SEQ ID NO: 6932 - DNA, 20 bp, Artificial Sequence
  Description of Artificial Sequence: Synthetic oligonucleotide
gtggggatccccaaaccccg

SEQ ID NO: 6933 - DNA, 20 bp, Artificial Sequence
  Description of Artificial Sequence: Synthetic oligonucleotide
tggggatccccaaaccccgc

SEQ ID NO: 6934 - DNA, 20 bp, Artificial Sequence
  Description of Artificial Sequence: Synthetic oligonucleotide
ggggatccccaaaccccgcc

SEQ ID NO: 6935 - DNA, 20 bp, Artificial Sequence
  Description of Artificial Sequence: Synthetic oligonucleotide
gggatccccaaaccccgcct

SEQ ID NO: 6936 - DNA, 20 bp, Artificial Sequence
  Description of Artificial Sequence: Synthetic oligonucleotide
ggatccccaaaccccgcctt

SEQ ID NO: 6937 - DNA, 20 bp, Artificial Sequence
  Description of Artificial Sequence: Synthetic oligonucleotide
gatccccaaaccccgccttg

SEQ ID NO: 6938 - DNA, 20 bp, Artificial Sequence
  Description of Artificial Sequence: Synthetic oligonucleotide
atccccaaaccccgccttgt

SEQ ID NO: 6939 - DNA, 20 bp, Artificial Sequence
  Description of Artificial Sequence: Synthetic oligonucleotide
tccccaaaccccgccttgta

SEQ ID NO: 6940 - DNA, 20 bp, Artificial Sequence
  Description of Artificial Sequence: Synthetic oligonucleotide
ccccaaaccccgccttgtag

SEQ ID NO: 6941 - DNA, 20 bp, Artificial Sequence
  Description of Artificial Sequence: Synthetic oligonucleotide
cccaaaccccgccttgtagg

SEQ ID NO: 6942 - DNA, 20 bp, Artificial Sequence
  Description of Artificial Sequence: Synthetic oligonucleotide
ccaaaccccgccttgtaggc

SEQ ID NO: 6943 - DNA, 20 bp, Artificial Sequence
  Description of Artificial Sequence: Synthetic oligonucleotide
caaaccccgccttgtaggct

SEQ ID NO: 6944 - DNA, 20 bp, Artificial Sequence
  Description of Artificial Sequence: Synthetic oligonucleotide
aaaccccgccttgtaggctt

SEQ ID NO: 6945 - DNA, 20 bp, Artificial Sequence
  Description of Artificial Sequence: Synthetic oligonucleotide
aaccccgccttgtaggcttc

SEQ ID NO: 6946 - DNA, 20 bp, Artificial Sequence
  Description of Artificial Sequence: Synthetic oligonucleotide
accccgccttgtaggcttcc

SEQ ID NO: 6947 - DNA, 20 bp, Artificial Sequence
  Description of Artificial Sequence: Synthetic oligonucleotide
ccccgccttgtaggcttccc

SEQ ID NO: 6948 - DNA, 20 bp, Artificial Sequence
  Description of Artificial Sequence: Synthetic oligonucleotide
cccgccttgtaggcttccca

SEQ ID NO: 6949 - DNA, 20 bp, Artificial Sequence
  Description of Artificial Sequence: Synthetic oligonucleotide
ccgccttgtaggcttcccag

SEQ ID NO: 6950 - DNA, 20 bp, Artificial Sequence
  Description of Artificial Sequence: Synthetic oligonucleotide
cgccttgtaggcttcccagg

SEQ ID NO: 6951 - DNA, 20 bp, Artificial Sequence
  Description of Artificial Sequence: Synthetic oligonucleotide
gccttgtaggcttcccaggg

SEQ ID NO: 6952 - DNA, 20 bp, Artificial Sequence
  Description of Artificial Sequence: Synthetic oligonucleotide
ccttgtaggcttcccagggc

SEQ ID NO: 6953 - DNA, 20 bp, Artificial Sequence
  Description of Artificial Sequence: Synthetic oligonucleotide
cttgtaggcttcccagggcc

SEQ ID NO: 6954 - DNA, 20 bp, Artificial Sequence
  Description of Artificial Sequence: Synthetic oligonucleotide
ttgtaggcttcccagggccg

SEQ ID NO: 6955 - DNA, 20 bp, Artificial Sequence
  Description of Artificial Sequence: Synthetic oligonucleotide
tgtaggcttcccagggccgg

SEQ ID NO: 6956 - DNA, 20 bp, Artificial Sequence
  Description of Artificial Sequence: Synthetic oligonucleotide
gtaggcttcccagggccggt

SEQ ID NO: 6957 - DNA, 20 bp, Artificial Sequence
  Description of Artificial Sequence: Synthetic oligonucleotide
taggcttcccagggccggtt

SEQ ID NO: 6958 - DNA, 20 bp, Artificial Sequence
  Description of Artificial Sequence: Synthetic oligonucleotide
aggcttcccagggccggttg

SEQ ID NO: 6959 - DNA, 20 bp, Artificial Sequence
  Description of Artificial Sequence: Synthetic oligonucleotide
ggcttcccagggccggttga

SEQ ID NO: 6960 - DNA, 20 bp, Artificial Sequence
  Description of Artificial Sequence: Synthetic oligonucleotide
gcttcccagggccggttgaa

SEQ ID NO: 6961 - DNA, 20 bp, Artificial Sequence
  Description of Artificial Sequence: Synthetic oligonucleotide
cttcccagggccggttgaag

SEQ ID NO: 6962 - DNA, 20 bp, Artificial Sequence
  Description of Artificial Sequence: Synthetic oligonucleotide
ttcccagggccggttgaagt

SEQ ID NO: 6963 - DNA, 20 bp, Artificial Sequence
  Description of Artificial Sequence: Synthetic oligonucleotide
tcccagggccggttgaagtc

SEQ ID NO: 6964 - DNA, 20 bp, Artificial Sequence
  Description of Artificial Sequence: Synthetic oligonucleotide
cccagggccggttgaagtcc

SEQ ID NO: 6965 - DNA, 20 bp, Artificial Sequence
  Description of Artificial Sequence: Synthetic oligonucleotide
ccagggccggttgaagtcca

SEQ ID NO: 6966 - DNA, 20 bp, Artificial Sequence
  Description of Artificial Sequence: Synthetic oligonucleotide
cagggccggttgaagtccac

SEQ ID NO: 6967 - DNA, 20 bp, Artificial Sequence
  Description of Artificial Sequence: Synthetic oligonucleotide
agggccggttgaagtccact

SEQ ID NO: 6968 - DNA, 20 bp, Artificial Sequence
  Description of Artificial Sequence: Synthetic oligonucleotide
gggccggttgaagtccactg

SEQ ID NO: 6969 - DNA, 20 bp, Artificial Sequence
  Description of Artificial Sequence: Synthetic oligonucleotide
ggccggttgaagtccactga

SEQ ID NO: 6970 - DNA, 20 bp, Artificial Sequence
  Description of Artificial Sequence: Synthetic oligonucleotide
gccggttgaagtccactgag

SEQ ID NO: 6971 - DNA, 20 bp, Artificial Sequence
  Description of Artificial Sequence: Synthetic oligonucleotide
ccggttgaagtccactgagc

SEQ ID NO: 6972 - DNA, 20 bp, Artificial Sequence
  Description of Artificial Sequence: Synthetic oligonucleotide
cggttgaagtccactgagcc

SEQ ID NO: 6973 - DNA, 20 bp, Artificial Sequence
  Description of Artificial Sequence: Synthetic oligonucleotide
ggttgaagtccactgagcca

SEQ ID NO: 6974 - DNA, 20 bp, Artificial Sequence
  Description of Artificial Sequence: Synthetic oligonucleotide
gttgaagtccactgagccat

SEQ ID NO: 6975 - DNA, 20 bp, Artificial Sequence
  Description of Artificial Sequence: Synthetic oligonucleotide
ttgaagtccactgagccatc

SEQ ID NO: 6976 - DNA, 20 bp, Artificial Sequence
  Description of Artificial Sequence: Synthetic oligonucleotide
tgaagtccactgagccatcg

SEQ ID NO: 6977 - DNA, 20 bp, Artificial Sequence
  Description of Artificial Sequence: Synthetic oligonucleotide
gaagtccactgagccatcgt

SEQ ID NO: 6978 - DNA, 20 bp, Artificial Sequence
  Description of Artificial Sequence: Synthetic oligonucleotide
aagtccactgagccatcgtg

SEQ ID NO: 6979 - DNA, 20 bp, Artificial Sequence
  Description of Artificial Sequence: Synthetic oligonucleotide
agtccactgagccatcgtgg

SEQ ID NO: 6980 - DNA, 20 bp, Artificial Sequence
  Description of Artificial Sequence: Synthetic oligonucleotide
gtccactgagccatcgtggc

SEQ ID NO: 6981 - DNA, 20 bp, Artificial Sequence
  Description of Artificial Sequence: Synthetic oligonucleotide
tccactgagccatcgtggcg

SEQ ID NO: 6982 - DNA, 20 bp, Artificial Sequence
  Description of Artificial Sequence: Synthetic oligonucleotide
ccactgagccatcgtggcgc

SEQ ID NO: 6983 - DNA, 20 bp, Artificial Sequence
  Description of Artificial Sequence: Synthetic oligonucleotide
cactgagccatcgtggcgcc

SEQ ID NO: 6984 - DNA, 20 bp, Artificial Sequence
  Description of Artificial Sequence: Synthetic oligonucleotide
actgagccatcgtggcgcct

SEQ ID NO: 6985 - DNA, 20 bp, Artificial Sequence
  Description of Artificial Sequence: Synthetic oligonucleotide
ctgagccatcgtggcgcctc

SEQ ID NO: 6986 - DNA, 20 bp, Artificial Sequence
  Description of Artificial Sequence: Synthetic oligonucleotide
tgagccatcgtggcgcctct

SEQ ID NO: 6987 - DNA, 20 bp, Artificial Sequence
  Description of Artificial Sequence: Synthetic oligonucleotide
gagccatcgtggcgcctctg

SEQ ID NO: 6988 - DNA, 20 bp, Artificial Sequence
  Description of Artificial Sequence: Synthetic oligonucleotide
agccatcgtggcgcctctga

SEQ ID NO: 6989 - DNA, 20 bp, Artificial Sequence
  Description of Artificial Sequence: Synthetic oligonucleotide
gccatcgtggcgcctctgaa

SEQ ID NO: 6990 - DNA, 20 bp, Artificial Sequence
  Description of Artificial Sequence: Synthetic oligonucleotide
ccatcgtggcgcctctgaat

SEQ ID NO: 6991 - DNA, 20 bp, Artificial Sequence
  Description of Artificial Sequence: Synthetic oligonucleotide
catcgtggcgcctctgaatt

SEQ ID NO: 6992 - DNA, 20 bp, Artificial Sequence
  Description of Artificial Sequence: Synthetic oligonucleotide
atcgtggcgcctctgaatta

SEQ ID NO: 6993 - DNA, 20 bp, Artificial Sequence
  Description of Artificial Sequence: Synthetic oligonucleotide
tcgtggcgcctctgaattac

SEQ ID NO: 6994 - DNA, 20 bp, Artificial Sequence
  Description of Artificial Sequence: Synthetic oligonucleotide
cgtggcgcctctgaattact

SEQ ID NO: 6995 - DNA, 20 bp, Artificial Sequence
  Description of Artificial Sequence: Synthetic oligonucleotide
gtggcgcctctgaattactg

SEQ ID NO: 6996 - DNA, 20 bp, Artificial Sequence
  Description of Artificial Sequence: Synthetic oligonucleotide
tggcgcctctgaattactgt

SEQ ID NO: 6997 - DNA, 20 bp, Artificial Sequence
  Description of Artificial Sequence: Synthetic oligonucleotide
ggcgcctctgaattactgtc

SEQ ID NO: 6998 - DNA, 20 bp, Artificial Sequence
  Description of Artificial Sequence: Synthetic oligonucleotide
gcgcctctgaattactgtcc

SEQ ID NO: 6999 - DNA, 20 bp, Artificial Sequence
  Description of Artificial Sequence: Synthetic oligonucleotide
cgcctctgaattactgtcca

SEQ ID NO: 7000 - DNA, 20 bp, Artificial Sequence
  Description of Artificial Sequence: Synthetic oligonucleotide
gcctctgaattactgtccag

SEQ ID NO: 7001 - DNA, 20 bp, Artificial Sequence
  Description of Artificial Sequence: Synthetic oligonucleotide
cctctgaattactgtccagc

SEQ ID NO: 7002 - DNA, 20 bp, Artificial Sequence
  Description of Artificial Sequence: Synthetic oligonucleotide
ctctgaattactgtccagcc

SEQ ID NO: 7003 - DNA, 20 bp, Artificial Sequence
  Description of Artificial Sequence: Synthetic oligonucleotide
tctgaattactgtccagcct

SEQ ID NO: 7004 - DNA, 20 bp, Artificial Sequence
  Description of Artificial Sequence: Synthetic oligonucleotide
ctgaattactgtccagcctc

SEQ ID NO: 7005 - DNA, 20 bp, Artificial Sequence
  Description of Artificial Sequence: Synthetic oligonucleotide
tgaattactgtccagcctcc

SEQ ID NO: 7006 - DNA, 20 bp, Artificial Sequence
  Description of Artificial Sequence: Synthetic oligonucleotide
gaattactgtccagcctcca

SEQ ID NO: 7007 - DNA, 20 bp, Artificial Sequence
  Description of Artificial Sequence: Synthetic oligonucleotide
aattactgtccagcctccat

SEQ ID NO: 7008 - DNA, 20 bp, Artificial Sequence
  Description of Artificial Sequence: Synthetic oligonucleotide
attactgtccagcctccatc

SEQ ID NO: 7009 - DNA, 20 bp, Artificial Sequence
  Description of Artificial Sequence: Synthetic oligonucleotide
ttactgtccagcctccatct

SEQ ID NO: 7010 - DNA, 20 bp, Artificial Sequence
  Description of Artificial Sequence: Synthetic oligonucleotide
tactgtccagcctccatctg

SEQ ID NO: 7011 - DNA, 20 bp, Artificial Sequence
  Description of Artificial Sequence: Synthetic oligonucleotide
actgtccagcctccatctgc

SEQ ID NO: 7012 - DNA, 20 bp, Artificial Sequence
  Description of Artificial Sequence: Synthetic oligonucleotide
ctgtccagcctccatctgcc

SEQ ID NO: 7013 - DNA, 20 bp, Artificial Sequence
  Description of Artificial Sequence: Synthetic oligonucleotide
tgtccagcctccatctgccc

SEQ ID NO: 7014 - DNA, 20 bp, Artificial Sequence
  Description of Artificial Sequence: Synthetic oligonucleotide
gtccagcctccatctgccca

SEQ ID NO: 7015 - DNA, 20 bp, Artificial Sequence
  Description of Artificial Sequence: Synthetic oligonucleotide
tccagcctccatctgcccag

SEQ ID NO: 7016 - DNA, 20 bp, Artificial Sequence
  Description of Artificial Sequence: Synthetic oligonucleotide
ccagcctccatctgcccaga

SEQ ID NO: 7017 - DNA, 20 bp, Artificial Sequence
  Description of Artificial Sequence: Synthetic oligonucleotide
cagcctccatctgcccagaa

SEQ ID NO: 7018 - DNA, 20 bp, Artificial Sequence
  Description of Artificial Sequence: Synthetic oligonucleotide
agcctccatctgcccagaaa

SEQ ID NO: 7019 - DNA, 20 bp, Artificial Sequence
  Description of Artificial Sequence: Synthetic oligonucleotide
gcctccatctgcccagaaag

SEQ ID NO: 7020 - DNA, 20 bp, Artificial Sequence
  Description of Artificial Sequence: Synthetic oligonucleotide
cctccatctgcccagaaagg

SEQ ID NO: 7021 - DNA, 20 bp, Artificial Sequence
  Description of Artificial Sequence: Synthetic oligonucleotide
ctccatctgcccagaaaggt

SEQ ID NO: 7022 - DNA, 20 bp, Artificial Sequence
  Description of Artificial Sequence: Synthetic oligonucleotide
tccatctgcccagaaaggta

SEQ ID NO: 7023 - DNA, 20 bp, Artificial Sequence
  Description of Artificial Sequence: Synthetic oligonucleotide
ccatctgcccagaaaggtac

SEQ ID NO: 7024 - DNA, 20 bp, Artificial Sequence
  Description of Artificial Sequence: Synthetic oligonucleotide
catctgcccagaaaggtaca

SEQ ID NO: 7025 - DNA, 20 bp, Artificial Sequence
  Description of Artificial Sequence: Synthetic oligonucleotide
atctgcccagaaaggtacaa

SEQ ID NO: 7026 - DNA, 20 bp, Artificial Sequence
  Description of Artificial Sequence: Synthetic oligonucleotide
tctgcccagaaaggtacaag

SEQ ID NO: 7027 - DNA, 20 bp, Artificial Sequence
  Description of Artificial Sequence: Synthetic oligonucleotide
ctgcccagaaaggtacaagg

SEQ ID NO: 7028 - DNA, 20 bp, Artificial Sequence
  Description of Artificial Sequence: Synthetic oligonucleotide
tgcccagaaaggtacaaggt

SEQ ID NO: 7029 - DNA, 20 bp, Artificial Sequence
  Description of Artificial Sequence: Synthetic oligonucleotide
gcccagaaaggtacaaggtc

SEQ ID NO: 7030 - DNA, 20 bp, Artificial Sequence
  Description of Artificial Sequence: Synthetic oligonucleotide
cccagaaaggtacaaggtca

SEQ ID NO: 7031 - DNA, 20 bp, Artificial Sequence
  Description of Artificial Sequence: Synthetic oligonucleotide
ccagaaaggtacaaggtcac

SEQ ID NO: 7032 - DNA, 20 bp, Artificial Sequence
  Description of Artificial Sequence: Synthetic oligonucleotide
cagaaaggtacaaggtcacc

SEQ ID NO: 7033 - DNA, 20 bp, Artificial Sequence
  Description of Artificial Sequence: Synthetic oligonucleotide
agaaaggtacaaggtcacca

SEQ ID NO: 7034 - DNA, 20 bp, Artificial Sequence
  Description of Artificial Sequence: Synthetic oligonucleotide
gaaaggtacaaggtcaccag

SEQ ID NO: 7035 - DNA, 20 bp, Artificial Sequence
  Description of Artificial Sequence: Synthetic oligonucleotide
aaaggtacaaggtcaccagg

SEQ ID NO: 7036 - DNA, 20 bp, Artificial Sequence
  Description of Artificial Sequence: Synthetic oligonucleotide
aaggtacaaggtcaccagga

SEQ ID NO: 7037 - DNA, 20 bp, Artificial Sequence
  Description of Artificial Sequence: Synthetic oligonucleotide
aggtacaaggtcaccaggaa

SEQ ID NO: 7038 - DNA, 20 bp, Artificial Sequence
  Description of Artificial Sequence: Synthetic oligonucleotide
ggtacaaggtcaccaggaag

SEQ ID NO: 7039 - DNA, 20 bp, Artificial Sequence
  Description of Artificial Sequence: Synthetic oligonucleotide
gtacaaggtcaccaggaagt

SEQ ID NO: 7040 - DNA, 20 bp, Artificial Sequence
  Description of Artificial Sequence: Synthetic oligonucleotide
tacaaggtcaccaggaagtc

SEQ ID NO: 7041 - DNA, 20 bp, Artificial Sequence
  Description of Artificial Sequence: Synthetic oligonucleotide
acaaggtcaccaggaagtcc

SEQ ID NO: 7042 - DNA, 20 bp, Artificial Sequence
  Description of Artificial Sequence: Synthetic oligonucleotide
caaggtcaccaggaagtccc

SEQ ID NO: 7043 - DNA, 20 bp, Artificial Sequence
  Description of Artificial Sequence: Synthetic oligonucleotide
aaggtcaccaggaagtccct

SEQ ID NO: 7044 - DNA, 20 bp, Artificial Sequence
  Description of Artificial Sequence: Synthetic oligonucleotide
aggtcaccaggaagtccctc

SEQ ID NO: 7045 - DNA, 20 bp, Artificial Sequence
  Description of Artificial Sequence: Synthetic oligonucleotide
ggtcaccaggaagtccctct

SEQ ID NO: 7046 - DNA, 20 bp, Artificial Sequence
  Description of Artificial Sequence: Synthetic oligonucleotide
gtcaccaggaagtccctctt

SEQ ID NO: 7047 - DNA, 20 bp, Artificial Sequence
  Description of Artificial Sequence: Synthetic oligonucleotide
tcaccaggaagtccctcttc

SEQ ID NO: 7048 - DNA, 20 bp, Artificial Sequence
  Description of Artificial Sequence: Synthetic oligonucleotide
caccaggaagtccctcttca

SEQ ID NO: 7049 - DNA, 20 bp, Artificial Sequence
  Description of Artificial Sequence: Synthetic oligonucleotide
accaggaagtccctcttcac

SEQ ID NO: 7050 - DNA, 20 bp, Artificial Sequence
  Description of Artificial Sequence: Synthetic oligonucleotide
ccaggaagtccctcttcaca

SEQ ID NO: 7051 - DNA, 20 bp, Artificial Sequence
  Description of Artificial Sequence: Synthetic oligonucleotide
caggaagtccctcttcacag

SEQ ID NO: 7052 - DNA, 20 bp, Artificial Sequence
  Description of Artificial Sequence: Synthetic oligonucleotide
aggaagtccctcttcacaga

SEQ ID NO: 7053 - DNA, 20 bp, Artificial Sequence
  Description of Artificial Sequence: Synthetic oligonucleotide
ggaagtccctcttcacagac

SEQ ID NO: 7054 - DNA, 20 bp, Artificial Sequence
  Description of Artificial Sequence: Synthetic oligonucleotide
gaagtccctcttcacagacg

SEQ ID NO: 7055 - DNA, 20 bp, Artificial Sequence
  Description of Artificial Sequence: Synthetic oligonucleotide
aagtccctcttcacagacga

SEQ ID NO: 7056 - DNA, 20 bp, Artificial Sequence
  Description of Artificial Sequence: Synthetic oligonucleotide
agtccctcttcacagacgac

SEQ ID NO: 7057 - DNA, 20 bp, Artificial Sequence
  Description of Artificial Sequence: Synthetic oligonucleotide
gtccctcttcacagacgacc

SEQ ID NO: 7058 - DNA, 20 bp, Artificial Sequence
  Description of Artificial Sequence: Synthetic oligonucleotide
tccctcttcacagacgaccc

SEQ ID NO: 7059 - DNA, 20 bp, Artificial Sequence
  Description of Artificial Sequence: Synthetic oligonucleotide
ccctcttcacagacgacccc

SEQ ID NO: 7060 - DNA, 20 bp, Artificial Sequence
  Description of Artificial Sequence: Synthetic oligonucleotide
cctcttcacagacgacccca

SEQ ID NO: 7061 - DNA, 20 bp, Artificial Sequence
  Description of Artificial Sequence: Synthetic oligonucleotide
ctcttcacagacgaccccac

SEQ ID NO: 7062 - DNA, 20 bp, Artificial Sequence
  Description of Artificial Sequence: Synthetic oligonucleotide
tcttcacagacgaccccact

SEQ ID NO: 7063 - DNA, 20 bp, Artificial Sequence
  Description of Artificial Sequence: Synthetic oligonucleotide
cttcacagacgaccccactc

SEQ ID NO: 7064 - DNA, 20 bp, Artificial Sequence
  Description of Artificial Sequence: Synthetic oligonucleotide
ttcacagacgaccccactcc

SEQ ID NO: 7065 - DNA, 20 bp, Artificial Sequence
  Description of Artificial Sequence: Synthetic oligonucleotide
tcacagacgaccccactccc

SEQ ID NO: 7066 - DNA, 20 bp, Artificial Sequence
  Description of Artificial Sequence: Synthetic oligonucleotide
cacagacgaccccactccct

SEQ ID NO: 7067 - DNA, 20 bp, Artificial Sequence
  Description of Artificial Sequence: Synthetic oligonucleotide
acagacgaccccactccctc

SEQ ID NO: 7068 - DNA, 20 bp, Artificial Sequence
  Description of Artificial Sequence: Synthetic oligonucleotide
cagacgaccccactccctca

SEQ ID NO: 7069 - DNA, 20 bp, Artificial Sequence
  Description of Artificial Sequence: Synthetic oligonucleotide
agacgaccccactccctcat

SEQ ID NO: 7070 - DNA, 20 bp, Artificial Sequence
  Description of Artificial Sequence: Synthetic oligonucleotide
gacgaccccactccctcatc

SEQ ID NO: 7071 - DNA, 20 bp, Artificial Sequence
  Description of Artificial Sequence: Synthetic oligonucleotide
acgaccccactccctcatct

SEQ ID NO: 7072 - DNA, 20 bp, Artificial Sequence
  Description of Artificial Sequence: Synthetic oligonucleotide
cgaccccactccctcatctg

SEQ ID NO: 7073 - DNA, 20 bp, Artificial Sequence
  Description of Artificial Sequence: Synthetic oligonucleotide
gaccccactccctcatctgg

SEQ ID NO: 7074 - DNA, 20 bp, Artificial Sequence
  Description of Artificial Sequence: Synthetic oligonucleotide
accccactccctcatctggc

SEQ ID NO: 7075 - DNA, 20 bp, Artificial Sequence
  Description of Artificial Sequence: Synthetic oligonucleotide
ccccactccctcatctggct

SEQ ID NO: 7076 - DNA, 20 bp, Artificial Sequence
  Description of Artificial Sequence: Synthetic oligonucleotide
cccactccctcatctggctg

SEQ ID NO: 7077 - DNA, 20 bp, Artificial Sequence
  Description of Artificial Sequence: Synthetic oligonucleotide
ccactccctcatctggctgc

SEQ ID NO: 7078 - DNA, 20 bp, Artificial Sequence
  Description of Artificial Sequence: Synthetic oligonucleotide
cactccctcatctggctgcc

SEQ ID NO: 7079 - DNA, 20 bp, Artificial Sequence
  Description of Artificial Sequence: Synthetic oligonucleotide
actccctcatctggctgcca

SEQ ID NO: 7080 - DNA, 20 bp, Artificial Sequence
  Description of Artificial Sequence: Synthetic oligonucleotide
ctccctcatctggctgccaa

SEQ ID NO: 7081 - DNA, 20 bp, Artificial Sequence
  Description of Artificial Sequence: Synthetic oligonucleotide
tccctcatctggctgccaag

SEQ ID NO: 7082 - DNA, 20 bp, Artificial Sequence
  Description of Artificial Sequence: Synthetic oligonucleotide
ccctcatctggctgccaagc

SEQ ID NO: 7083 - DNA, 20 bp, Artificial Sequence
  Description of Artificial Sequence: Synthetic oligonucleotide
cctcatctggctgccaagca

SEQ ID NO: 7084 - DNA, 20 bp, Artificial Sequence
  Description of Artificial Sequence: Synthetic oligonucleotide
ctcatctggctgccaagcac

SEQ ID NO: 7085 - DNA, 20 bp, Artificial Sequence
  Description of Artificial Sequence: Synthetic oligonucleotide
tcatctggctgccaagcacc

SEQ ID NO: 7086 - DNA, 20 bp, Artificial Sequence
  Description of Artificial Sequence: Synthetic oligonucleotide
catctggctgccaagcacca

SEQ ID NO: 7087 - DNA, 20 bp, Artificial Sequence
  Description of Artificial Sequence: Synthetic oligonucleotide
atctggctgccaagcaccaa

SEQ ID NO: 7088 - DNA, 20 bp, Artificial Sequence
  Description of Artificial Sequence: Synthetic oligonucleotide
tctggctgccaagcaccaaa

SEQ ID NO: 7089 - DNA, 20 bp, Artificial Sequence
  Description of Artificial Sequence: Synthetic oligonucleotide
ctggctgccaagcaccaaac

SEQ ID NO: 7090 - DNA, 20 bp, Artificial Sequence
  Description of Artificial Sequence: Synthetic oligonucleotide
tggctgccaagcaccaaacc

SEQ ID NO: 7091 - DNA, 20 bp, Artificial Sequence
  Description of Artificial Sequence: Synthetic oligonucleotide
ggctgccaagcaccaaaccc

SEQ ID NO: 7092 - DNA, 20 bp, Artificial Sequence
  Description of Artificial Sequence: Synthetic oligonucleotide
gctgccaagcaccaaacccc

SEQ ID NO: 7093 - DNA, 20 bp, Artificial Sequence
  Description of Artificial Sequence: Synthetic oligonucleotide
ctgccaagcaccaaaccccc

SEQ ID NO: 7094 - DNA, 20 bp, Artificial Sequence
  Description of Artificial Sequence: Synthetic oligonucleotide
tgccaagcaccaaaccccct

SEQ ID NO: 7095 - DNA, 20 bp, Artificial Sequence
  Description of Artificial Sequence: Synthetic oligonucleotide
gccaagcaccaaaccccctc

SEQ ID NO: 7096 - DNA, 20 bp, Artificial Sequence
  Description of Artificial Sequence: Synthetic oligonucleotide
ccaagcaccaaaccccctcc

SEQ ID NO: 7097 - DNA, 20 bp, Artificial Sequence
  Description of Artificial Sequence: Synthetic oligonucleotide
caagcaccaaaccccctcca

SEQ ID NO: 7098 - DNA, 20 bp, Artificial Sequence
  Description of Artificial Sequence: Synthetic oligonucleotide
aagcaccaaaccccctccaa

SEQ ID NO: 7099 - DNA, 20 bp, Artificial Sequence
  Description of Artificial Sequence: Synthetic oligonucleotide
agcaccaaaccccctccaaa

SEQ ID NO: 7100 - DNA, 20 bp, Artificial Sequence
  Description of Artificial Sequence: Synthetic oligonucleotide
gcaccaaaccccctccaaac

SEQ ID NO: 7101 - DNA, 20 bp, Artificial Sequence
  Description of Artificial Sequence: Synthetic oligonucleotide
caccaaaccccctccaaacc

SEQ ID NO: 7102 - DNA, 20 bp, Artificial Sequence
  Description of Artificial Sequence: Synthetic oligonucleotide
accaaaccccctccaaaccc

SEQ ID NO: 7103 - DNA, 20 bp, Artificial Sequence
  Description of Artificial Sequence: Synthetic oligonucleotide
ccaaaccccctccaaaccca

SEQ ID NO: 7104 - DNA, 20 bp, Artificial Sequence
  Description of Artificial Sequence: Synthetic oligonucleotide
caaaccccctccaaacccag

SEQ ID NO: 7105 - DNA, 20 bp, Artificial Sequence
  Description of Artificial Sequence: Synthetic oligonucleotide
aaaccccctccaaacccagg

SEQ ID NO: 7106 - DNA, 20 bp, Artificial Sequence
  Description of Artificial Sequence: Synthetic oligonucleotide
aaccccctccaaacccagga

SEQ ID NO: 7107 - DNA, 20 bp, Artificial Sequence
  Description of Artificial Sequence: Synthetic oligonucleotide
accccctccaaacccaggaa

SEQ ID NO: 7108 - DNA, 20 bp, Artificial Sequence
  Description of Artificial Sequence: Synthetic oligonucleotide
ccccctccaaacccaggaag

SEQ ID NO: 7109 - DNA, 20 bp, Artificial Sequence
  Description of Artificial Sequence: Synthetic oligonucleotide
cccctccaaacccaggaaga

SEQ ID NO: 7110 - DNA, 20 bp, Artificial Sequence
  Description of Artificial Sequence: Synthetic oligonucleotide
ccctccaaacccaggaagac

SEQ ID NO: 7111 - DNA, 20 bp, Artificial Sequence
  Description of Artificial Sequence: Synthetic oligonucleotide
cctccaaacccaggaagaca

SEQ ID NO: 7112 - DNA, 20 bp, Artificial Sequence
  Description of Artificial Sequence: Synthetic oligonucleotide
ctccaaacccaggaagacag

SEQ ID NO: 7113 - DNA, 20 bp, Artificial Sequence
  Description of Artificial Sequence: Synthetic oligonucleotide
tccaaacccaggaagacagc

SEQ ID NO: 7114 - DNA, 20 bp, Artificial Sequence
  Description of Artificial Sequence: Synthetic oligonucleotide
ccaaacccaggaagacagca

SEQ ID NO: 7115 - DNA, 20 bp, Artificial Sequence
  Description of Artificial Sequence: Synthetic oligonucleotide
caaacccaggaagacagcag

SEQ ID NO: 7116 - DNA, 20 bp, Artificial Sequence
  Description of Artificial Sequence: Synthetic oligonucleotide
aaacccaggaagacagcagc

SEQ ID NO: 7117 - DNA, 20 bp, Artificial Sequence
  Description of Artificial Sequence: Synthetic oligonucleotide
aacccaggaagacagcagct

SEQ ID NO: 7118 - DNA, 20 bp, Artificial Sequence
  Description of Artificial Sequence: Synthetic oligonucleotide
acccaggaagacagcagctc

SEQ ID NO: 7119 - DNA, 20 bp, Artificial Sequence
  Description of Artificial Sequence: Synthetic oligonucleotide
cccaggaagacagcagctcc

SEQ ID NO: 7120 - DNA, 20 bp, Artificial Sequence
  Description of Artificial Sequence: Synthetic oligonucleotide
ccaggaagacagcagctccc

SEQ ID NO: 7121 - DNA, 20 bp, Artificial Sequence
  Description of Artificial Sequence: Synthetic oligonucleotide
caggaagacagcagctccct

SEQ ID NO: 7122 - DNA, 20 bp, Artificial Sequence
  Description of Artificial Sequence: Synthetic oligonucleotide
aggaagacagcagctccctc

SEQ ID NO: 7123 - DNA, 20 bp, Artificial Sequence
  Description of Artificial Sequence: Synthetic oligonucleotide
ggaagacagcagctccctca

SEQ ID NO: 7124 - DNA, 20 bp, Artificial Sequence
  Description of Artificial Sequence: Synthetic oligonucleotide
gaagacagcagctccctcac

SEQ ID NO: 7125 - DNA, 20 bp, Artificial Sequence
  Description of Artificial Sequence: Synthetic oligonucleotide
aagacagcagctccctcact

SEQ ID NO: 7126 - DNA, 20 bp, Artificial Sequence
  Description of Artificial Sequence: Synthetic oligonucleotide
agacagcagctccctcactc

SEQ ID NO: 7127 - DNA, 20 bp, Artificial Sequence
  Description of Artificial Sequence: Synthetic oligonucleotide
gacagcagctccctcactca

SEQ ID NO: 7128 - DNA, 20 bp, Artificial Sequence
  Description of Artificial Sequence: Synthetic oligonucleotide
acagcagctccctcactcat

SEQ ID NO: 7129 - DNA, 20 bp, Artificial Sequence
  Description of Artificial Sequence: Synthetic oligonucleotide
cagcagctccctcactcatc

SEQ ID NO: 7130 - DNA, 20 bp, Artificial Sequence
  Description of Artificial Sequence: Synthetic oligonucleotide
agcagctccctcactcatcc

SEQ ID NO: 7131 - DNA, 20 bp, Artificial Sequence
  Description of Artificial Sequence: Synthetic oligonucleotide
gcagctccctcactcatccc

SEQ ID NO: 7132 - DNA, 20 bp, Artificial Sequence
  Description of Artificial Sequence: Synthetic oligonucleotide
cagctccctcactcatccct

SEQ ID NO: 7133 - DNA, 20 bp, Artificial Sequence
  Description of Artificial Sequence: Synthetic oligonucleotide
agctccctcactcatccctg

SEQ ID NO: 7134 - DNA, 20 bp, Artificial Sequence
  Description of Artificial Sequence: Synthetic oligonucleotide
gctccctcactcatccctgg

SEQ ID NO: 7135 - DNA, 20 bp, Artificial Sequence
  Description of Artificial Sequence: Synthetic oligonucleotide
ctccctcactcatccctgga

SEQ ID NO: 7136 - DNA, 20 bp, Artificial Sequence
  Description of Artificial Sequence: Synthetic oligonucleotide
tccctcactcatccctggag

SEQ ID NO: 7137 - DNA, 20 bp, Artificial Sequence
  Description of Artificial Sequence: Synthetic oligonucleotide
ccctcactcatccctggagg

SEQ ID NO: 7138 - DNA, 20 bp, Artificial Sequence
  Description of Artificial Sequence: Synthetic oligonucleotide
cctcactcatccctggagga

SEQ ID NO: 7139 - DNA, 20 bp, Artificial Sequence
  Description of Artificial Sequence: Synthetic oligonucleotide
ctcactcatccctggaggac

SEQ ID NO: 7140 - DNA, 20 bp, Artificial Sequence
  Description of Artificial Sequence: Synthetic oligonucleotide
tcactcatccctggaggact

SEQ ID NO: 7141 - DNA, 20 bp, Artificial Sequence
  Description of Artificial Sequence: Synthetic oligonucleotide
cactcatccctggaggactc

SEQ ID NO: 7142 - DNA, 20 bp, Artificial Sequence
  Description of Artificial Sequence: Synthetic oligonucleotide
actcatccctggaggactcg

SEQ ID NO: 7143 - DNA, 20 bp, Artificial Sequence
  Description of Artificial Sequence: Synthetic oligonucleotide
ctcatccctggaggactcga

SEQ ID NO: 7144 - DNA, 20 bp, Artificial Sequence
  Description of Artificial Sequence: Synthetic oligonucleotide
tcatccctggaggactcgag

SEQ ID NO: 7145 - DNA, 20 bp, Artificial Sequence
  Description of Artificial Sequence: Synthetic oligonucleotide
catccctggaggactcgagg

SEQ ID NO: 7146 - DNA, 20 bp, Artificial Sequence
  Description of Artificial Sequence: Synthetic oligonucleotide
atccctggaggactcgagga

SEQ ID NO: 7147 - DNA, 20 bp, Artificial Sequence
  Description of Artificial Sequence: Synthetic oligonucleotide
tccctggaggactcgaggag

SEQ ID NO: 7148 - DNA, 20 bp, Artificial Sequence
  Description of Artificial Sequence: Synthetic oligonucleotide
ccctggaggactcgaggagg

SEQ ID NO: 7149 - DNA, 20 bp, Artificial Sequence
  Description of Artificial Sequence: Synthetic oligonucleotide
cctggaggactcgaggaggg

SEQ ID NO: 7150 - DNA, 20 bp, Artificial Sequence
  Description of Artificial Sequence: Synthetic oligonucleotide
ctggaggactcgaggagggt

SEQ ID NO: 7151 - DNA, 20 bp, Artificial Sequence
  Description of Artificial Sequence: Synthetic oligonucleotide
tggaggactcgaggagggtg

SEQ ID NO: 7152 - DNA, 20 bp, Artificial Sequence
  Description of Artificial Sequence: Synthetic oligonucleotide
ggaggactcgaggagggtgg

SEQ ID NO: 7153 - DNA, 20 bp, Artificial Sequence
  Description of Artificial Sequence: Synthetic oligonucleotide
gaggactcgaggagggtggg

SEQ ID NO: 7154 - DNA, 20 bp, Artificial Sequence
  Description of Artificial Sequence: Synthetic oligonucleotide
aggactcgaggagggtgggt

SEQ ID NO: 7155 - DNA, 20 bp, Artificial Sequence
  Description of Artificial Sequence: Synthetic oligonucleotide
ggactcgaggagggtgggtc

SEQ ID NO: 7156 - DNA, 20 bp, Artificial Sequence
  Description of Artificial Sequence: Synthetic oligonucleotide
gactcgaggagggtgggtca

SEQ ID NO: 7157 - DNA, 20 bp, Artificial Sequence
  Description of Artificial Sequence: Synthetic oligonucleotide
actcgaggagggtgggtcag

SEQ ID NO: 7158 - DNA, 20 bp, Artificial Sequence
  Description of Artificial Sequence: Synthetic oligonucleotide
ctcgaggagggtgggtcaga

SEQ ID NO: 7159 - DNA, 20 bp, Artificial Sequence
  Description of Artificial Sequence: Synthetic oligonucleotide
tcgaggagggtgggtcagag

SEQ ID NO: 7160 - DNA, 20 bp, Artificial Sequence
  Description of Artificial Sequence: Synthetic oligonucleotide
cgaggagggtgggtcagagg

SEQ ID NO: 7161 - DNA, 20 bp, Artificial Sequence
  Description of Artificial Sequence: Synthetic oligonucleotide
gaggagggtgggtcagaggg

SEQ ID NO: 7162 - DNA, 20 bp, Artificial Sequence
  Description of Artificial Sequence: Synthetic oligonucleotide
aggagggtgggtcagaggga

SEQ ID NO: 7163 - DNA, 20 bp, Artificial Sequence
  Description of Artificial Sequence: Synthetic oligonucleotide
ggagggtgggtcagagggag

SEQ ID NO: 7164 - DNA, 20 bp, Artificial Sequence
  Description of Artificial Sequence: Synthetic oligonucleotide
gagggtgggtcagagggagg

SEQ ID NO: 7165 - DNA, 20 bp, Artificial Sequence
  Description of Artificial Sequence: Synthetic oligonucleotide
agggtgggtcagagggagga

SEQ ID NO: 7166 - DNA, 20 bp, Artificial Sequence
  Description of Artificial Sequence: Synthetic oligonucleotide
gggtgggtcagagggaggaa

SEQ ID NO: 7167 - DNA, 20 bp, Artificial Sequence
  Description of Artificial Sequence: Synthetic oligonucleotide
ggtgggtcagagggaggaat

SEQ ID NO: 7168 - DNA, 20 bp, Artificial Sequence
  Description of Artificial Sequence: Synthetic oligonucleotide
gtgggtcagagggaggaata

SEQ ID NO: 7169 - DNA, 20 bp, Artificial Sequence
  Description of Artificial Sequence: Synthetic oligonucleotide
tgggtcagagggaggaatat

SEQ ID NO: 7170 - DNA, 20 bp, Artificial Sequence
  Description of Artificial Sequence: Synthetic oligonucleotide
gggtcagagggaggaatatt

SEQ ID NO: 7171 - DNA, 20 bp, Artificial Sequence
  Description of Artificial Sequence: Synthetic oligonucleotide
ggtcagagggaggaatatta

SEQ ID NO: 7172 - DNA, 20 bp, Artificial Sequence
  Description of Artificial Sequence: Synthetic oligonucleotide
gtcagagggaggaatattat

SEQ ID NO: 7173 - DNA, 20 bp, Artificial Sequence
  Description of Artificial Sequence: Synthetic oligonucleotide
tcagagggaggaatattatg

SEQ ID NO: 7174 - DNA, 20 bp, Artificial Sequence
  Description of Artificial Sequence: Synthetic oligonucleotide
cagagggaggaatattatgg

SEQ ID NO: 7175 - DNA, 20 bp, Artificial Sequence
  Description of Artificial Sequence: Synthetic oligonucleotide
agagggaggaatattatggg

SEQ ID NO: 7176 - DNA, 20 bp, Artificial Sequence
  Description of Artificial Sequence: Synthetic oligonucleotide
gagggaggaatattatgggc

SEQ ID NO: 7177 - DNA, 20 bp, Artificial Sequence
  Description of Artificial Sequence: Synthetic oligonucleotide
agggaggaatattatgggct

SEQ ID NO: 7178 - DNA, 20 bp, Artificial Sequence
  Description of Artificial Sequence: Synthetic oligonucleotide
gggaggaatattatgggctg

SEQ ID NO: 7179 - DNA, 20 bp, Artificial Sequence
  Description of Artificial Sequence: Synthetic oligonucleotide
ggaggaatattatgggctgg

SEQ ID NO: 7180 - DNA, 20 bp, Artificial Sequence
  Description of Artificial Sequence: Synthetic oligonucleotide
gaggaatattatgggctggc

SEQ ID NO: 7181 - DNA, 20 bp, Artificial Sequence
  Description of Artificial Sequence: Synthetic oligonucleotide
aggaatattatgggctggcc

SEQ ID NO: 7182 - DNA, 20 bp, Artificial Sequence
  Description of Artificial Sequence: Synthetic oligonucleotide
ggaatattatgggctggcct

SEQ ID NO: 7183 - DNA, 20 bp, Artificial Sequence
  Description of Artificial Sequence: Synthetic oligonucleotide
gaatattatgggctggcctt

SEQ ID NO: 7184 - DNA, 20 bp, Artificial Sequence
  Description of Artificial Sequence: Synthetic oligonucleotide
aatattatgggctggccttg

SEQ ID NO: 7185 - DNA, 20 bp, Artificial Sequence
  Description of Artificial Sequence: Synthetic oligonucleotide
atattatgggctggccttgg

SEQ ID NO: 7186 - DNA, 20 bp, Artificial Sequence
  Description of Artificial Sequence: Synthetic oligonucleotide
tattatgggctggccttggg

SEQ ID NO: 7187 - DNA, 20 bp, Artificial Sequence
  Description of Artificial Sequence: Synthetic oligonucleotide
attatgggctggccttggga

SEQ ID NO: 7188 - DNA, 20 bp, Artificial Sequence
  Description of Artificial Sequence: Synthetic oligonucleotide
ttatgggctggccttgggaa

SEQ ID NO: 7189 - DNA, 20 bp, Artificial Sequence
  Description of Artificial Sequence: Synthetic oligonucleotide
tatgggctggccttgggaag

SEQ ID NO: 7190 - DNA, 20 bp, Artificial Sequence
  Description of Artificial Sequence: Synthetic oligonucleotide
atgggctggccttgggaaga

SEQ ID NO: 7191 - DNA, 20 bp, Artificial Sequence
  Description of Artificial Sequence: Synthetic oligonucleotide
tgggctggccttgggaagat

SEQ ID NO: 7192 - DNA, 20 bp, Artificial Sequence
  Description of Artificial Sequence: Synthetic oligonucleotide
gggctggccttgggaagatc

SEQ ID NO: 7193 - DNA, 20 bp, Artificial Sequence
  Description of Artificial Sequence: Synthetic oligonucleotide
ggctggccttgggaagatct

SEQ ID NO: 7194 - DNA, 20 bp, Artificial Sequence
  Description of Artificial Sequence: Synthetic oligonucleotide
gctggccttgggaagatctt

SEQ ID NO: 7195 - DNA, 20 bp, Artificial Sequence
  Description of Artificial Sequence: Synthetic oligonucleotide
ctggccttgggaagatcttt

SEQ ID NO: 7196 - DNA, 20 bp, Artificial Sequence
  Description of Artificial Sequence: Synthetic oligonucleotide
tggccttgggaagatctttg

SEQ ID NO: 7197 - DNA, 20 bp, Artificial Sequence
  Description of Artificial Sequence: Synthetic oligonucleotide
ggccttgggaagatctttgt

SEQ ID NO: 7198 - DNA, 20 bp, Artificial Sequence
  Description of Artificial Sequence: Synthetic oligonucleotide
gccttgggaagatctttgtc

SEQ ID NO: 7199 - DNA, 20 bp, Artificial Sequence
  Description of Artificial Sequence: Synthetic oligonucleotide
ccttgggaagatctttgtcc

SEQ ID NO: 7200 - DNA, 20 bp, Artificial Sequence
  Description of Artificial Sequence: Synthetic oligonucleotide
cttgggaagatctttgtccc

SEQ ID NO: 7201 - DNA, 20 bp, Artificial Sequence
  Description of Artificial Sequence: Synthetic oligonucleotide
ttgggaagatctttgtccca

SEQ ID NO: 7202 - DNA, 20 bp, Artificial Sequence
  Description of Artificial Sequence: Synthetic oligonucleotide
tgggaagatctttgtcccaa

SEQ ID NO: 7203 - DNA, 20 bp, Artificial Sequence
  Description of Artificial Sequence: Synthetic oligonucleotide
gggaagatctttgtcccaag

SEQ ID NO: 7204 - DNA, 20 bp, Artificial Sequence
  Description of Artificial Sequence: Synthetic oligonucleotide
ggaagatctttgtcccaaga

SEQ ID NO: 7205 - DNA, 20 bp, Artificial Sequence
  Description of Artificial Sequence: Synthetic oligonucleotide
gaagatctttgtcccaagaa

SEQ ID NO: 7206 - DNA, 20 bp, Artificial Sequence
  Description of Artificial Sequence: Synthetic oligonucleotide
aagatctttgtcccaagaac

SEQ ID NO: 7207 - DNA, 20 bp, Artificial Sequence
  Description of Artificial Sequence: Synthetic oligonucleotide
agatctttgtcccaagaacc

SEQ ID NO: 7208 - DNA, 20 bp, Artificial Sequence
  Description of Artificial Sequence: Synthetic oligonucleotide
gatctttgtcccaagaaccc

SEQ ID NO: 7209 - DNA, 20 bp, Artificial Sequence
  Description of Artificial Sequence: Synthetic oligonucleotide
atctttgtcccaagaaccca

SEQ ID NO: 7210 - DNA, 20 bp, Artificial Sequence
  Description of Artificial Sequence: Synthetic oligonucleotide
tctttgtcccaagaacccag

SEQ ID NO: 7211 - DNA, 20 bp, Artificial Sequence
  Description of Artificial Sequence: Synthetic oligonucleotide
ctttgtcccaagaacccagc

SEQ ID NO: 7212 - DNA, 20 bp, Artificial Sequence
  Description of Artificial Sequence: Synthetic oligonucleotide
tttgtcccaagaacccagca

SEQ ID NO: 7213 - DNA, 20 bp, Artificial Sequence
  Description of Artificial Sequence: Synthetic oligonucleotide
ttgtcccaagaacccagcag

SEQ ID NO: 7214 - DNA, 20 bp, Artificial Sequence
  Description of Artificial Sequence: Synthetic oligonucleotide
tgtcccaagaacccagcagg

SEQ ID NO: 7215 - DNA, 20 bp, Artificial Sequence
  Description of Artificial Sequence: Synthetic oligonucleotide
gtcccaagaacccagcaggg

SEQ ID NO: 7216 - DNA, 20 bp, Artificial Sequence
  Description of Artificial Sequence: Synthetic oligonucleotide
tcccaagaacccagcaggga

SEQ ID NO: 7217 - DNA, 20 bp, Artificial Sequence
  Description of Artificial Sequence: Synthetic oligonucleotide
cccaagaacccagcagggac

SEQ ID NO: 7218 - DNA, 20 bp, Artificial Sequence
  Description of Artificial Sequence: Synthetic oligonucleotide
ccaagaacccagcagggact

SEQ ID NO: 7219 - DNA, 20 bp, Artificial Sequence
  Description of Artificial Sequence: Synthetic oligonucleotide
caagaacccagcagggactg

SEQ ID NO: 7220 - DNA, 20 bp, Artificial Sequence
  Description of Artificial Sequence: Synthetic oligonucleotide
aagaacccagcagggactga

SEQ ID NO: 7221 - DNA, 20 bp, Artificial Sequence
  Description of Artificial Sequence: Synthetic oligonucleotide
agaacccagcagggactgag

SEQ ID NO: 7222 - DNA, 20 bp, Artificial Sequence
  Description of Artificial Sequence: Synthetic oligonucleotide
gaacccagcagggactgagt

SEQ ID NO: 7223 - DNA, 20 bp, Artificial Sequence
  Description of Artificial Sequence: Synthetic oligonucleotide
aacccagcagggactgagtg

SEQ ID NO: 7224 - DNA, 20 bp, Artificial Sequence
  Description of Artificial Sequence: Synthetic oligonucleotide
acccagcagggactgagtgt

SEQ ID NO: 7225 - DNA, 20 bp, Artificial Sequence
  Description of Artificial Sequence: Synthetic oligonucleotide
cccagcagggactgagtgtg

SEQ ID NO: 7226 - DNA, 20 bp, Artificial Sequence
  Description of Artificial Sequence: Synthetic oligonucleotide
ccagcagggactgagtgtgg

SEQ ID NO: 7227 - DNA, 20 bp, Artificial Sequence
  Description of Artificial Sequence: Synthetic oligonucleotide
cagcagggactgagtgtggg

SEQ ID NO: 7228 - DNA, 20 bp, Artificial Sequence
  Description of Artificial Sequence: Synthetic oligonucleotide
agcagggactgagtgtggga

SEQ ID NO: 7229 - DNA, 20 bp, Artificial Sequence
  Description of Artificial Sequence: Synthetic oligonucleotide
gcagggactgagtgtgggag

SEQ ID NO: 7230 - DNA, 20 bp, Artificial Sequence
  Description of Artificial Sequence: Synthetic oligonucleotide
cagggactgagtgtgggagg

SEQ ID NO: 7231 - DNA, 20 bp, Artificial Sequence
  Description of Artificial Sequence: Synthetic oligonucleotide
agggactgagtgtgggaggg

SEQ ID NO: 7232 - DNA, 20 bp, Artificial Sequence
  Description of Artificial Sequence: Synthetic oligonucleotide
gggactgagtgtgggaggga

SEQ ID NO: 7233 - DNA, 20 bp, Artificial Sequence
  Description of Artificial Sequence: Synthetic oligonucleotide
ggactgagtgtgggagggag

SEQ ID NO: 7234 - DNA, 20 bp, Artificial Sequence
  Description of Artificial Sequence: Synthetic oligonucleotide
gactgagtgtgggagggagt

SEQ ID NO: 7235 - DNA, 20 bp, Artificial Sequence
  Description of Artificial Sequence: Synthetic oligonucleotide
actgagtgtgggagggagta

SEQ ID NO: 7236 - DNA, 20 bp, Artificial Sequence
  Description of Artificial Sequence: Synthetic oligonucleotide
ctgagtgtgggagggagtag

SEQ ID NO: 7237 - DNA, 20 bp, Artificial Sequence
  Description of Artificial Sequence: Synthetic oligonucleotide
tgagtgtgggagggagtagg

SEQ ID NO: 7238 - DNA, 20 bp, Artificial Sequence
  Description of Artificial Sequence: Synthetic oligonucleotide
gagtgtgggagggagtaggc

SEQ ID NO: 7239 - DNA, 20 bp, Artificial Sequence
  Description of Artificial Sequence: Synthetic oligonucleotide
agtgtgggagggagtaggca

SEQ ID NO: 7240 - DNA, 20 bp, Artificial Sequence
  Description of Artificial Sequence: Synthetic oligonucleotide
gtgtgggagggagtaggcag

SEQ ID NO: 7241 - DNA, 20 bp, Artificial Sequence
  Description of Artificial Sequence: Synthetic oligonucleotide
tgtgggagggagtaggcagt

SEQ ID NO: 7242 - DNA, 20 bp, Artificial Sequence
  Description of Artificial Sequence: Synthetic oligonucleotide
gtgggagggagtaggcagtg

SEQ ID NO: 7243 - DNA, 20 bp, Artificial Sequence
  Description of Artificial Sequence: Synthetic oligonucleotide
tgggagggagtaggcagtgg

SEQ ID NO: 7244 - DNA, 20 bp, Artificial Sequence
  Description of Artificial Sequence: Synthetic oligonucleotide
gggagggagtaggcagtgga

SEQ ID NO: 7245 - DNA, 20 bp, Artificial Sequence
  Description of Artificial Sequence: Synthetic oligonucleotide
ggagggagtaggcagtggaa

SEQ ID NO: 7246 - DNA, 20 bp, Artificial Sequence
  Description of Artificial Sequence: Synthetic oligonucleotide
gagggagtaggcagtggaaa

SEQ ID NO: 7247 - DNA, 20 bp, Artificial Sequence
  Description of Artificial Sequence: Synthetic oligonucleotide
agggagtaggcagtggaaat

SEQ ID NO: 7248 - DNA, 20 bp, Artificial Sequence
  Description of Artificial Sequence: Synthetic oligonucleotide
gggagtaggcagtggaaatc

SEQ ID NO: 7249 - DNA, 20 bp, Artificial Sequence
  Description of Artificial Sequence: Synthetic oligonucleotide
ggagtaggcagtggaaatct

SEQ ID NO: 7250 - DNA, 20 bp, Artificial Sequence
  Description of Artificial Sequence: Synthetic oligonucleotide
gagtaggcagtggaaatctg

SEQ ID NO: 7251 - DNA, 20 bp, Artificial Sequence
  Description of Artificial Sequence: Synthetic oligonucleotide
agtaggcagtggaaatctgc

SEQ ID NO: 7252 - DNA, 20 bp, Artificial Sequence
  Description of Artificial Sequence: Synthetic oligonucleotide
gtaggcagtggaaatctgca

SEQ ID NO: 7253 - DNA, 20 bp, Artificial Sequence
  Description of Artificial Sequence: Synthetic oligonucleotide
taggcagtggaaatctgcaa

SEQ ID NO: 7254 - DNA, 20 bp, Artificial Sequence
  Description of Artificial Sequence: Synthetic oligonucleotide
aggcagtggaaatctgcaaa

SEQ ID NO: 7255 - DNA, 20 bp, Artificial Sequence
  Description of Artificial Sequence: Synthetic oligonucleotide
ggcagtggaaatctgcaaag

SEQ ID NO: 7256 - DNA, 20 bp, Artificial Sequence
  Description of Artificial Sequence: Synthetic oligonucleotide
gcagtggaaatctgcaaagc

SEQ ID NO: 7257 - DNA, 20 bp, Artificial Sequence
  Description of Artificial Sequence: Synthetic oligonucleotide
cagtggaaatctgcaaagcc

SEQ ID NO: 7258 - DNA, 20 bp, Artificial Sequence
  Description of Artificial Sequence: Synthetic oligonucleotide
agtggaaatctgcaaagcct

SEQ ID NO: 7259 - DNA, 20 bp, Artificial Sequence
  Description of Artificial Sequence: Synthetic oligonucleotide
gtggaaatctgcaaagcctc

SEQ ID NO: 7260 - DNA, 20 bp, Artificial Sequence
  Description of Artificial Sequence: Synthetic oligonucleotide
tggaaatctgcaaagcctct

SEQ ID NO: 7261 - DNA, 20 bp, Artificial Sequence
  Description of Artificial Sequence: Synthetic oligonucleotide
ggaaatctgcaaagcctctc

SEQ ID NO: 7262 - DNA, 20 bp, Artificial Sequence
  Description of Artificial Sequence: Synthetic oligonucleotide
gaaatctgcaaagcctctct

SEQ ID NO: 7263 - DNA, 20 bp, Artificial Sequence
  Description of Artificial Sequence: Synthetic oligonucleotide
aaatctgcaaagcctctctg

SEQ ID NO: 7264 - DNA, 20 bp, Artificial Sequence
  Description of Artificial Sequence: Synthetic oligonucleotide
aatctgcaaagcctctctgg

SEQ ID NO: 7265 - DNA, 20 bp, Artificial Sequence
  Description of Artificial Sequence: Synthetic oligonucleotide
atctgcaaagcctctctggg

SEQ ID NO: 7266 - DNA, 20 bp, Artificial Sequence
  Description of Artificial Sequence: Synthetic oligonucleotide
tctgcaaagcctctctgggc

SEQ ID NO: 7267 - DNA, 20 bp, Artificial Sequence
  Description of Artificial Sequence: Synthetic oligonucleotide
ctgcaaagcctctctgggcc

SEQ ID NO: 7268 - DNA, 20 bp, Artificial Sequence
  Description of Artificial Sequence: Synthetic oligonucleotide
tgcaaagcctctctgggcca

SEQ ID NO: 7269 - DNA, 20 bp, Artificial Sequence
  Description of Artificial Sequence: Synthetic oligonucleotide
gcaaagcctctctgggccag

SEQ ID NO: 7270 - DNA, 20 bp, Artificial Sequence
  Description of Artificial Sequence: Synthetic oligonucleotide
caaagcctctctgggccagc

SEQ ID NO: 7271 - DNA, 20 bp, Artificial Sequence
  Description of Artificial Sequence: Synthetic oligonucleotide
aaagcctctctgggccagct

SEQ ID NO: 7272 - DNA, 20 bp, Artificial Sequence
  Description of Artificial Sequence: Synthetic oligonucleotide
aagcctctctgggccagctg

SEQ ID NO: 7273 - DNA, 20 bp, Artificial Sequence
  Description of Artificial Sequence: Synthetic oligonucleotide
agcctctctgggccagctga

SEQ ID NO: 7274 - DNA, 20 bp, Artificial Sequence
  Description of Artificial Sequence: Synthetic oligonucleotide
gcctctctgggccagctgaa

SEQ ID NO: 7275 - DNA, 20 bp, Artificial Sequence
  Description of Artificial Sequence: Synthetic oligonucleotide
cctctctgggccagctgaac

SEQ ID NO: 7276 - DNA, 20 bp, Artificial Sequence
  Description of Artificial Sequence: Synthetic oligonucleotide
ctctctgggccagctgaact

SEQ ID NO: 7277 - DNA, 20 bp, Artificial Sequence
  Description of Artificial Sequence: Synthetic oligonucleotide
tctctgggccagctgaactg

SEQ ID NO: 7278 - DNA, 20 bp, Artificial Sequence
  Description of Artificial Sequence: Synthetic oligonucleotide
ctctgggccagctgaactgg

SEQ ID NO: 7279 - DNA, 20 bp, Artificial Sequence
  Description of Artificial Sequence: Synthetic oligonucleotide
tctgggccagctgaactggg

SEQ ID NO: 7280 - DNA, 20 bp, Artificial Sequence
  Description of Artificial Sequence: Synthetic oligonucleotide
ctgggccagctgaactgggt

SEQ ID NO: 7281 - DNA, 20 bp, Artificial Sequence
  Description of Artificial Sequence: Synthetic oligonucleotide
tgggccagctgaactgggta

SEQ ID NO: 7282 - DNA, 20 bp, Artificial Sequence
  Description of Artificial Sequence: Synthetic oligonucleotide
gggccagctgaactgggtaa

SEQ ID NO: 7283 - DNA, 20 bp, Artificial Sequence
  Description of Artificial Sequence: Synthetic oligonucleotide
ggccagctgaactgggtaaa

SEQ ID NO: 7284 - DNA, 20 bp, Artificial Sequence
  Description of Artificial Sequence: Synthetic oligonucleotide
gccagctgaactgggtaaaa

SEQ ID NO: 7285 - DNA, 20 bp, Artificial Sequence
  Description of Artificial Sequence: Synthetic oligonucleotide
ccagctgaactgggtaaaac

SEQ ID NO: 7286 - DNA, 20 bp, Artificial Sequence
  Description of Artificial Sequence: Synthetic oligonucleotide
cagctgaactgggtaaaacc

SEQ ID NO: 7287 - DNA, 20 bp, Artificial Sequence
  Description of Artificial Sequence: Synthetic oligonucleotide
agctgaactgggtaaaaccc

SEQ ID NO: 7288 - DNA, 20 bp, Artificial Sequence
  Description of Artificial Sequence: Synthetic oligonucleotide
gctgaactgggtaaaacccc

SEQ ID NO: 7289 - DNA, 20 bp, Artificial Sequence
  Description of Artificial Sequence: Synthetic oligonucleotide
ctgaactgggtaaaaccccg

SEQ ID NO: 7290 - DNA, 20 bp, Artificial Sequence
  Description of Artificial Sequence: Synthetic oligonucleotide
tgaactgggtaaaaccccgt

SEQ ID NO: 7291 - DNA, 20 bp, Artificial Sequence
  Description of Artificial Sequence: Synthetic oligonucleotide
gaactgggtaaaaccccgtg

SEQ ID NO: 7292 - DNA, 20 bp, Artificial Sequence
  Description of Artificial Sequence: Synthetic oligonucleotide
aactgggtaaaaccccgtgt

SEQ ID NO: 7293 - DNA, 20 bp, Artificial Sequence
  Description of Artificial Sequence: Synthetic oligonucleotide
actgggtaaaaccccgtgtt

SEQ ID NO: 7294 - DNA, 20 bp, Artificial Sequence
  Description of Artificial Sequence: Synthetic oligonucleotide
ctgggtaaaaccccgtgttg

SEQ ID NO: 7295 - DNA, 20 bp, Artificial Sequence
  Description of Artificial Sequence: Synthetic oligonucleotide
tgggtaaaaccccgtgttgt

SEQ ID NO: 7296 - DNA, 20 bp, Artificial Sequence
  Description of Artificial Sequence: Synthetic oligonucleotide
gggtaaaaccccgtgttgta

SEQ ID NO: 7297 - DNA, 20 bp, Artificial Sequence
  Description of Artificial Sequence: Synthetic oligonucleotide
ggtaaaaccccgtgttgtaa

SEQ ID NO: 7298 - DNA, 20 bp, Artificial Sequence
  Description of Artificial Sequence: Synthetic oligonucleotide
gtaaaaccccgtgttgtaac

SEQ ID NO: 7299 - DNA, 20 bp, Artificial Sequence
  Description of Artificial Sequence: Synthetic oligonucleotide
taaaaccccgtgttgtaacc

SEQ ID NO: 7300 - DNA, 20 bp, Artificial Sequence
  Description of Artificial Sequence: Synthetic oligonucleotide
aaaaccccgtgttgtaacct

SEQ ID NO: 7301 - DNA, 20 bp, Artificial Sequence
  Description of Artificial Sequence: Synthetic oligonucleotide
aaaccccgtgttgtaacctc

SEQ ID NO: 7302 - DNA, 20 bp, Artificial Sequence
  Description of Artificial Sequence: Synthetic oligonucleotide
aaccccgtgttgtaacctct

SEQ ID NO: 7303 - DNA, 20 bp, Artificial Sequence
  Description of Artificial Sequence: Synthetic oligonucleotide
accccgtgttgtaacctctt

SEQ ID NO: 7304 - DNA, 20 bp, Artificial Sequence
  Description of Artificial Sequence: Synthetic oligonucleotide
ccccgtgttgtaacctcttg

SEQ ID NO: 7305 - DNA, 20 bp, Artificial Sequence
  Description of Artificial Sequence: Synthetic oligonucleotide
cccgtgttgtaacctcttgt

SEQ ID NO: 7306 - DNA, 20 bp, Artificial Sequence
  Description of Artificial Sequence: Synthetic oligonucleotide
ccgtgttgtaacctcttgta

SEQ ID NO: 7307 - DNA, 20 bp, Artificial Sequence
  Description of Artificial Sequence: Synthetic oligonucleotide
cgtgttgtaacctcttgtaa

SEQ ID NO: 7308 - DNA, 20 bp, Artificial Sequence
  Description of Artificial Sequence: Synthetic oligonucleotide
gtgttgtaacctcttgtaat

SEQ ID NO: 7309 - DNA, 20 bp, Artificial Sequence
  Description of Artificial Sequence: Synthetic oligonucleotide
tgttgtaacctcttgtaatg

SEQ ID NO: 7310 - DNA, 20 bp, Artificial Sequence
  Description of Artificial Sequence: Synthetic oligonucleotide
gttgtaacctcttgtaatgg

SEQ ID NO: 7311 - DNA, 20 bp, Artificial Sequence
  Description of Artificial Sequence: Synthetic oligonucleotide
ttgtaacctcttgtaatgga

SEQ ID NO: 7312 - DNA, 20 bp, Artificial Sequence
  Description of Artificial Sequence: Synthetic oligonucleotide
tgtaacctcttgtaatggaa

SEQ ID NO: 7313 - DNA, 20 bp, Artificial Sequence
  Description of Artificial Sequence: Synthetic oligonucleotide
gtaacctcttgtaatggaaa

SEQ ID NO: 7314 - DNA, 20 bp, Artificial Sequence
  Description of Artificial Sequence: Synthetic oligonucleotide
taacctcttgtaatggaaag

SEQ ID NO: 7315 - DNA, 20 bp, Artificial Sequence
  Description of Artificial Sequence: Synthetic oligonucleotide
aacctcttgtaatggaaagg

SEQ ID NO: 7316 - DNA, 20 bp, Artificial Sequence
  Description of Artificial Sequence: Synthetic oligonucleotide
acctcttgtaatggaaagga

SEQ ID NO: 7317 - DNA, 20 bp, Artificial Sequence
  Description of Artificial Sequence: Synthetic oligonucleotide
cctcttgtaatggaaaggac

SEQ ID NO: 7318 - DNA, 20 bp, Artificial Sequence
  Description of Artificial Sequence: Synthetic oligonucleotide
ctcttgtaatggaaaggact

SEQ ID NO: 7319 - DNA, 20 bp, Artificial Sequence
  Description of Artificial Sequence: Synthetic oligonucleotide
tcttgtaatggaaaggactt

SEQ ID NO: 7320 - DNA, 20 bp, Artificial Sequence
  Description of Artificial Sequence: Synthetic oligonucleotide
cttgtaatggaaaggacttc

SEQ ID NO: 7321 - DNA, 20 bp, Artificial Sequence
  Description of Artificial Sequence: Synthetic oligonucleotide
ttgtaatggaaaggacttct

SEQ ID NO: 7322 - DNA, 20 bp, Artificial Sequence
  Description of Artificial Sequence: Synthetic oligonucleotide
tgtaatggaaaggacttctc

SEQ ID NO: 7323 - DNA, 20 bp, Artificial Sequence
  Description of Artificial Sequence: Synthetic oligonucleotide
gtaatggaaaggacttctca

SEQ ID NO: 7324 - DNA, 20 bp, Artificial Sequence
  Description of Artificial Sequence: Synthetic oligonucleotide
taatggaaaggacttctcag

SEQ ID NO: 7325 - DNA, 20 bp, Artificial Sequence
  Description of Artificial Sequence: Synthetic oligonucleotide
aatggaaaggacttctcagt

SEQ ID NO: 7326 - DNA, 20 bp, Artificial Sequence
  Description of Artificial Sequence: Synthetic oligonucleotide
atggaaaggacttctcagtg

SEQ ID NO: 7327 - DNA, 20 bp, Artificial Sequence
  Description of Artificial Sequence: Synthetic oligonucleotide
tggaaaggacttctcagtgg

SEQ ID NO: 7328 - DNA, 20 bp, Artificial Sequence
  Description of Artificial Sequence: Synthetic oligonucleotide
ggaaaggacttctcagtgga

SEQ ID NO: 7329 - DNA, 20 bp, Artificial Sequence
  Description of Artificial Sequence: Synthetic oligonucleotide
gaaaggacttctcagtggaa

SEQ ID NO: 7330 - DNA, 20 bp, Artificial Sequence
  Description of Artificial Sequence: Synthetic oligonucleotide
aaaggacttctcagtggaaa

SEQ ID NO: 7331 - DNA, 20 bp, Artificial Sequence
  Description of Artificial Sequence: Synthetic oligonucleotide
aaggacttctcagtggaaaa

SEQ ID NO: 7332 - DNA, 20 bp, Artificial Sequence
  Description of Artificial Sequence: Synthetic oligonucleotide
aggacttctcagtggaaaaa

SEQ ID NO: 7333 - DNA, 20 bp, Artificial Sequence
  Description of Artificial Sequence: Synthetic oligonucleotide
ggacttctcagtggaaaaaa

SEQ ID NO: 7334 - DNA, 20 bp, Artificial Sequence
  Description of Artificial Sequence: Synthetic oligonucleotide
gacttctcagtggaaaaaaa

SEQ ID NO: 7335 - DNA, 20 bp, Artificial Sequence
  Description of Artificial Sequence: Synthetic oligonucleotide
acttctcagtggaaaaaaaa

SEQ ID NO: 7336 - DNA, 20 bp, Artificial Sequence
  Description of Artificial Sequence: Synthetic oligonucleotide
cttctcagtggaaaaaaaag

SEQ ID NO: 7337 - DNA, 20 bp, Artificial Sequence
  Description of Artificial Sequence: Synthetic oligonucleotide
ttctcagtggaaaaaaaagc

SEQ ID NO: 7338 - DNA, 20 bp, Artificial Sequence
  Description of Artificial Sequence: Synthetic oligonucleotide
tctcagtggaaaaaaaagct

SEQ ID NO: 7339 - DNA, 20 bp, Artificial Sequence
  Description of Artificial Sequence: Synthetic oligonucleotide
ctcagtggaaaaaaaagctt

SEQ ID NO: 7340 - DNA, 20 bp, Artificial Sequence
  Description of Artificial Sequence: Synthetic oligonucleotide
tcagtggaaaaaaaagcttt

SEQ ID NO: 7341 - DNA, 20 bp, Artificial Sequence
  Description of Artificial Sequence: Synthetic oligonucleotide
cagtggaaaaaaaagctttc

SEQ ID NO: 7342 - DNA, 20 bp, Artificial Sequence
  Description of Artificial Sequence: Synthetic oligonucleotide
agtggaaaaaaaagctttct

SEQ ID NO: 7343 - DNA, 20 bp, Artificial Sequence
  Description of Artificial Sequence: Synthetic oligonucleotide
gtggaaaaaaaagctttctt

SEQ ID NO: 7344 - DNA, 20 bp, Artificial Sequence
  Description of Artificial Sequence: Synthetic oligonucleotide
tggaaaaaaaagctttcttt

SEQ ID NO: 7345 - DNA, 20 bp, Artificial Sequence
  Description of Artificial Sequence: Synthetic oligonucleotide
ggaaaaaaaagctttctttt

SEQ ID NO: 7346 - DNA, 20 bp, Artificial Sequence
  Description of Artificial Sequence: Synthetic oligonucleotide
gaaaaaaaagctttcttttt

SEQ ID NO: 7347 - DNA, 20 bp, Artificial Sequence
  Description of Artificial Sequence: Synthetic oligonucleotide
aaaaaaaagctttctttttt

SEQ ID NO: 7348 - DNA, 20 bp, Artificial Sequence
  Description of Artificial Sequence: Synthetic oligonucleotide
aaaaaaagctttcttttttt

SEQ ID NO: 7349 - DNA, 20 bp, Artificial Sequence
  Description of Artificial Sequence: Synthetic oligonucleotide
aaaaaagctttctttttttt

SEQ ID NO: 7350 - DNA, 20 bp, Artificial Sequence
  Description of Artificial Sequence: Synthetic oligonucleotide
aaaaagctttcttttttttt

SEQ ID NO: 7351 - DNA, 20 bp, Artificial Sequence
  Description of Artificial Sequence: Synthetic oligonucleotide
aaaagctttctttttttttt

SEQ ID NO: 7352 - DNA, 20 bp, Artificial Sequence
  Description of Artificial Sequence: Synthetic oligonucleotide
aaagctttcttttttttttt

SEQ ID NO: 7353 - DNA, 20 bp, Artificial Sequence
  Description of Artificial Sequence: Synthetic oligonucleotide
aagctttctttttttttttt

SEQ ID NO: 7354 - DNA, 20 bp, Artificial Sequence
  Description of Artificial Sequence: Synthetic oligonucleotide
agctttcttttttttttttt

SEQ ID NO: 7355 - DNA, 20 bp, Artificial Sequence
  Description of Artificial Sequence: Synthetic oligonucleotide
gctttctttttttttttttt

SEQ ID NO: 7356 - DNA, 20 bp, Artificial Sequence
  Description of Artificial Sequence: Synthetic oligonucleotide
ctttcttttttttttttttt

SEQ ID NO: 7357 - DNA, 20 bp, Artificial Sequence
  Description of Artificial Sequence: Synthetic oligonucleotide
tttctttttttttttttttt

SEQ ID NO: 7358 - DNA, 20 bp, Artificial Sequence
  Description of Artificial Sequence: Synthetic oligonucleotide
ttcttttttttttttttttt

SEQ ID NO: 7359 - DNA, 20 bp, Artificial Sequence
  Description of Artificial Sequence: Synthetic oligonucleotide
tctttttttttttttttttt

SEQ ID NO: 7360 - DNA, 20 bp, Artificial Sequence
  Description of Artificial Sequence: Synthetic oligonucleotide
cttttttttttttttttttt

SEQ ID NO: 7361 - DNA, 20 bp, Artificial Sequence
  Description of Artificial Sequence: Synthetic oligonucleotide
tttttttttttttttttttt

SEQ ID NO: 7362 - DNA, 20 bp, Artificial Sequence
  Description of Artificial Sequence: Synthetic oligonucleotide
tttttttttttttttttttt

SEQ ID NO: 7363 - DNA, 20 bp, Artificial Sequence
  Description of Artificial Sequence: Synthetic oligonucleotide
ttttttttttttttttttta

SEQ ID NO: 7364 - DNA, 20 bp, Artificial Sequence
  Description of Artificial Sequence: Synthetic oligonucleotide
ttttttttttttttttttag

SEQ ID NO: 7365 - DNA, 20 bp, Artificial Sequence
  Description of Artificial Sequence: Synthetic oligonucleotide
tttttttttttttttttaga

SEQ ID NO: 7366 - DNA, 20 bp, Artificial Sequence
  Description of Artificial Sequence: Synthetic oligonucleotide
ttttttttttttttttagag

SEQ ID NO: 7367 - DNA, 20 bp, Artificial Sequence
  Description of Artificial Sequence: Synthetic oligonucleotide
tttttttttttttttagaga

SEQ ID NO: 7368 - DNA, 20 bp, Artificial Sequence
  Description of Artificial Sequence: Synthetic oligonucleotide
ttttttttttttttagagat

SEQ ID NO: 7369 - DNA, 20 bp, Artificial Sequence
  Description of Artificial Sequence: Synthetic oligonucleotide
tttttttttttttagagatg

SEQ ID NO: 7370 - DNA, 20 bp, Artificial Sequence
  Description of Artificial Sequence: Synthetic oligonucleotide
ttttttttttttagagatgg

SEQ ID NO: 7371 - DNA, 20 bp, Artificial Sequence
  Description of Artificial Sequence: Synthetic oligonucleotide
tttttttttttagagatgga

SEQ ID NO: 7372 - DNA, 20 bp, Artificial Sequence
  Description of Artificial Sequence: Synthetic oligonucleotide
ttttttttttagagatggag

SEQ ID NO: 7373 - DNA, 20 bp, Artificial Sequence
  Description of Artificial Sequence: Synthetic oligonucleotide
tttttttttagagatggagt

SEQ ID NO: 7374 - DNA, 20 bp, Artificial Sequence
  Description of Artificial Sequence: Synthetic oligonucleotide
ttttttttagagatggagtc

SEQ ID NO: 7375 - DNA, 20 bp, Artificial Sequence
  Description of Artificial Sequence: Synthetic oligonucleotide
tttttttagagatggagtct

SEQ ID NO: 7376 - DNA, 20 bp, Artificial Sequence
  Description of Artificial Sequence: Synthetic oligonucleotide
ttttttagagatggagtctc

SEQ ID NO: 7377 - DNA, 20 bp, Artificial Sequence
  Description of Artificial Sequence: Synthetic oligonucleotide
tttttagagatggagtctca

SEQ ID NO: 7378 - DNA, 20 bp, Artificial Sequence
  Description of Artificial Sequence: Synthetic oligonucleotide
ttttagagatggagtctcac

SEQ ID NO: 7379 - DNA, 20 bp, Artificial Sequence
  Description of Artificial Sequence: Synthetic oligonucleotide
tttagagatggagtctcact

SEQ ID NO: 7380 - DNA, 20 bp, Artificial Sequence
  Description of Artificial Sequence: Synthetic oligonucleotide
ttagagatggagtctcactc

SEQ ID NO: 7381 - DNA, 20 bp, Artificial Sequence
  Description of Artificial Sequence: Synthetic oligonucleotide
tagagatggagtctcactct

SEQ ID NO: 7382 - DNA, 20 bp, Artificial Sequence
  Description of Artificial Sequence: Synthetic oligonucleotide
agagatggagtctcactctg

SEQ ID NO: 7383 - DNA, 20 bp, Artificial Sequence
  Description of Artificial Sequence: Synthetic oligonucleotide
gagatggagtctcactctgt

SEQ ID NO: 7384 - DNA, 20 bp, Artificial Sequence
  Description of Artificial Sequence: Synthetic oligonucleotide
agatggagtctcactctgtt

SEQ ID NO: 7385 - DNA, 20 bp, Artificial Sequence
  Description of Artificial Sequence: Synthetic oligonucleotide
gatggagtctcactctgttg

SEQ ID NO: 7386 - DNA, 20 bp, Artificial Sequence
  Description of Artificial Sequence: Synthetic oligonucleotide
atggagtctcactctgttgc

SEQ ID NO: 7387 - DNA, 20 bp, Artificial Sequence
  Description of Artificial Sequence: Synthetic oligonucleotide
tggagtctcactctgttgcc

SEQ ID NO: 7388 - DNA, 20 bp, Artificial Sequence
  Description of Artificial Sequence: Synthetic oligonucleotide
ggagtctcactctgttgccc

SEQ ID NO: 7389 - DNA, 20 bp, Artificial Sequence
  Description of Artificial Sequence: Synthetic oligonucleotide
gagtctcactctgttgccca

SEQ ID NO: 7390 - DNA, 20 bp, Artificial Sequence
  Description of Artificial Sequence: Synthetic oligonucleotide
agtctcactctgttgcccag

SEQ ID NO: 7391 - DNA, 20 bp, Artificial Sequence
  Description of Artificial Sequence: Synthetic oligonucleotide
gtctcactctgttgcccagg

SEQ ID NO: 7392 - DNA, 20 bp, Artificial Sequence
  Description of Artificial Sequence: Synthetic oligonucleotide
tctcactctgttgcccaggc

SEQ ID NO: 7393 - DNA, 20 bp, Artificial Sequence
  Description of Artificial Sequence: Synthetic oligonucleotide
ctcactctgttgcccaggct

SEQ ID NO: 7394 - DNA, 20 bp, Artificial Sequence
  Description of Artificial Sequence: Synthetic oligonucleotide
tcactctgttgcccaggctg

SEQ ID NO: 7395 - DNA, 20 bp, Artificial Sequence
  Description of Artificial Sequence: Synthetic oligonucleotide
cactctgttgcccaggctgg

SEQ ID NO: 7396 - DNA, 20 bp, Artificial Sequence
  Description of Artificial Sequence: Synthetic oligonucleotide
actctgttgcccaggctgga

SEQ ID NO: 7397 - DNA, 20 bp, Artificial Sequence
  Description of Artificial Sequence: Synthetic oligonucleotide
ctctgttgcccaggctggat

SEQ ID NO: 7398 - DNA, 20 bp, Artificial Sequence
  Description of Artificial Sequence: Synthetic oligonucleotide
tctgttgcccaggctggatc

SEQ ID NO: 7399 - DNA, 20 bp, Artificial Sequence
  Description of Artificial Sequence: Synthetic oligonucleotide
ctgttgcccaggctggatcg

SEQ ID NO: 7400 - DNA, 20 bp, Artificial Sequence
  Description of Artificial Sequence: Synthetic oligonucleotide
tgttgcccaggctggatcgc

SEQ ID NO: 7401 - DNA, 20 bp, Artificial Sequence
  Description of Artificial Sequence: Synthetic oligonucleotide
gttgcccaggctggatcgca

SEQ ID NO: 7402 - DNA, 20 bp, Artificial Sequence
  Description of Artificial Sequence: Synthetic oligonucleotide
ttgcccaggctggatcgcag

SEQ ID NO: 7403 - DNA, 20 bp, Artificial Sequence
  Description of Artificial Sequence: Synthetic oligonucleotide
tgcccaggctggatcgcagt

SEQ ID NO: 7404 - DNA, 20 bp, Artificial Sequence
  Description of Artificial Sequence: Synthetic oligonucleotide
gcccaggctggatcgcagtg

SEQ ID NO: 7405 - DNA, 20 bp, Artificial Sequence
  Description of Artificial Sequence: Synthetic oligonucleotide
cccaggctggatcgcagtgc

SEQ ID NO: 7406 - DNA, 20 bp, Artificial Sequence
  Description of Artificial Sequence: Synthetic oligonucleotide
ccaggctggatcgcagtgcc

SEQ ID NO: 7407 - DNA, 20 bp, Artificial Sequence
  Description of Artificial Sequence: Synthetic oligonucleotide
caggctggatcgcagtgccg

SEQ ID NO: 7408 - DNA, 20 bp, Artificial Sequence
  Description of Artificial Sequence: Synthetic oligonucleotide
aggctggatcgcagtgccgc

SEQ ID NO: 7409 - DNA, 20 bp, Artificial Sequence
  Description of Artificial Sequence: Synthetic oligonucleotide
ggctggatcgcagtgccgca

SEQ ID NO: 7410 - DNA, 20 bp, Artificial Sequence
  Description of Artificial Sequence: Synthetic oligonucleotide
gctggatcgcagtgccgcaa

SEQ ID NO: 7411 - DNA, 20 bp, Artificial Sequence
  Description of Artificial Sequence: Synthetic oligonucleotide
ctggatcgcagtgccgcaat

SEQ ID NO: 7412 - DNA, 20 bp, Artificial Sequence
  Description of Artificial Sequence: Synthetic oligonucleotide
tggatcgcagtgccgcaatc

SEQ ID NO: 7413 - DNA, 20 bp, Artificial Sequence
  Description of Artificial Sequence: Synthetic oligonucleotide
ggatcgcagtgccgcaatct

SEQ ID NO: 7414 - DNA, 20 bp, Artificial Sequence
  Description of Artificial Sequence: Synthetic oligonucleotide
gatcgcagtgccgcaatctc

SEQ ID NO: 7415 - DNA, 20 bp, Artificial Sequence
  Description of Artificial Sequence: Synthetic oligonucleotide
atcgcagtgccgcaatctca

SEQ ID NO: 7416 - DNA, 20 bp, Artificial Sequence
  Description of Artificial Sequence: Synthetic oligonucleotide
tcgcagtgccgcaatctcag

SEQ ID NO: 7417 - DNA, 20 bp, Artificial Sequence
  Description of Artificial Sequence: Synthetic oligonucleotide
cgcagtgccgcaatctcagc

SEQ ID NO: 7418 - DNA, 20 bp, Artificial Sequence
  Description of Artificial Sequence: Synthetic oligonucleotide
gcagtgccgcaatctcagct

SEQ ID NO: 7419 - DNA, 20 bp, Artificial Sequence
  Description of Artificial Sequence: Synthetic oligonucleotide
cagtgccgcaatctcagctc

SEQ ID NO: 7420 - DNA, 20 bp, Artificial Sequence
  Description of Artificial Sequence: Synthetic oligonucleotide
agtgccgcaatctcagctca

SEQ ID NO: 7421 - DNA, 20 bp, Artificial Sequence
  Description of Artificial Sequence: Synthetic oligonucleotide
gtgccgcaatctcagctcac

SEQ ID NO: 7422 - DNA, 20 bp, Artificial Sequence
  Description of Artificial Sequence: Synthetic oligonucleotide
tgccgcaatctcagctcact

SEQ ID NO: 7423 - DNA, 20 bp, Artificial Sequence
  Description of Artificial Sequence: Synthetic oligonucleotide
gccgcaatctcagctcactg

SEQ ID NO: 7424 - DNA, 20 bp, Artificial Sequence
  Description of Artificial Sequence: Synthetic oligonucleotide
ccgcaatctcagctcactgc

SEQ ID NO: 7425 - DNA, 20 bp, Artificial Sequence
  Description of Artificial Sequence: Synthetic oligonucleotide
cgcaatctcagctcactgca

SEQ ID NO: 7426 - DNA, 20 bp, Artificial Sequence
  Description of Artificial Sequence: Synthetic oligonucleotide
gcaatctcagctcactgcaa

SEQ ID NO: 7427 - DNA, 20 bp, Artificial Sequence
  Description of Artificial Sequence: Synthetic oligonucleotide
caatctcagctcactgcaac

SEQ ID NO: 7428 - DNA, 20 bp, Artificial Sequence
  Description of Artificial Sequence: Synthetic oligonucleotide
aatctcagctcactgcaacc

SEQ ID NO: 7429 - DNA, 20 bp, Artificial Sequence
  Description of Artificial Sequence: Synthetic oligonucleotide
atctcagctcactgcaacct

SEQ ID NO: 7430 - DNA, 20 bp, Artificial Sequence
  Description of Artificial Sequence: Synthetic oligonucleotide
tctcagctcactgcaacctc

SEQ ID NO: 7431 - DNA, 20 bp, Artificial Sequence
  Description of Artificial Sequence: Synthetic oligonucleotide
ctcagctcactgcaacctct

SEQ ID NO: 7432 - DNA, 20 bp, Artificial Sequence
  Description of Artificial Sequence: Synthetic oligonucleotide
tcagctcactgcaacctctg

SEQ ID NO: 7433 - DNA, 20 bp, Artificial Sequence
  Description of Artificial Sequence: Synthetic oligonucleotide
cagctcactgcaacctctgc

SEQ ID NO: 7434 - DNA, 20 bp, Artificial Sequence
  Description of Artificial Sequence: Synthetic oligonucleotide
agctcactgcaacctctgcc

SEQ ID NO: 7435 - DNA, 20 bp, Artificial Sequence
  Description of Artificial Sequence: Synthetic oligonucleotide
gctcactgcaacctctgcct

SEQ ID NO: 7436 - DNA, 20 bp, Artificial Sequence
  Description of Artificial Sequence: Synthetic oligonucleotide
ctcactgcaacctctgcctt

SEQ ID NO: 7437 - DNA, 20 bp, Artificial Sequence
  Description of Artificial Sequence: Synthetic oligonucleotide
tcactgcaacctctgccttc

SEQ ID NO: 7438 - DNA, 20 bp, Artificial Sequence
  Description of Artificial Sequence: Synthetic oligonucleotide
cactgcaacctctgccttcg

SEQ ID NO: 7439 - DNA, 20 bp, Artificial Sequence
  Description of Artificial Sequence: Synthetic oligonucleotide
actgcaacctctgccttcgg

SEQ ID NO: 7440 - DNA, 20 bp, Artificial Sequence
  Description of Artificial Sequence: Synthetic oligonucleotide
ctgcaacctctgccttcggg

SEQ ID NO: 7441 - DNA, 20 bp, Artificial Sequence
  Description of Artificial Sequence: Synthetic oligonucleotide
tgcaacctctgccttcgggg

SEQ ID NO: 7442 - DNA, 20 bp, Artificial Sequence
  Description of Artificial Sequence: Synthetic oligonucleotide
gcaacctctgccttcggggc

SEQ ID NO: 7443 - DNA, 20 bp, Artificial Sequence
  Description of Artificial Sequence: Synthetic oligonucleotide
caacctctgccttcggggct

SEQ ID NO: 7444 - DNA, 20 bp, Artificial Sequence
  Description of Artificial Sequence: Synthetic oligonucleotide
aacctctgccttcggggctc

SEQ ID NO: 7445 - DNA, 20 bp, Artificial Sequence
  Description of Artificial Sequence: Synthetic oligonucleotide
acctctgccttcggggctca

SEQ ID NO: 7446 - DNA, 20 bp, Artificial Sequence
  Description of Artificial Sequence: Synthetic oligonucleotide
cctctgccttcggggctcaa

SEQ ID NO: 7447 - DNA, 20 bp, Artificial Sequence
  Description of Artificial Sequence: Synthetic oligonucleotide
ctctgccttcggggctcaag

SEQ ID NO: 7448 - DNA, 20 bp, Artificial Sequence
  Description of Artificial Sequence: Synthetic oligonucleotide
tctgccttcggggctcaagc

SEQ ID NO: 7449 - DNA, 20 bp, Artificial Sequence
  Description of Artificial Sequence: Synthetic oligonucleotide
ctgccttcggggctcaagcg

SEQ ID NO: 7450 - DNA, 20 bp, Artificial Sequence
  Description of Artificial Sequence: Synthetic oligonucleotide
tgccttcggggctcaagcga

SEQ ID NO: 7451 - DNA, 20 bp, Artificial Sequence
  Description of Artificial Sequence: Synthetic oligonucleotide
gccttcggggctcaagcgat

SEQ ID NO: 7452 - DNA, 20 bp, Artificial Sequence
  Description of Artificial Sequence: Synthetic oligonucleotide
ccttcggggctcaagcgatt

SEQ ID NO: 7453 - DNA, 20 bp, Artificial Sequence
  Description of Artificial Sequence: Synthetic oligonucleotide
cttcggggctcaagcgattc

SEQ ID NO: 7454 - DNA, 20 bp, Artificial Sequence
  Description of Artificial Sequence: Synthetic oligonucleotide
ttcggggctcaagcgattct

SEQ ID NO: 7455 - DNA, 20 bp, Artificial Sequence
  Description of Artificial Sequence: Synthetic oligonucleotide
tcggggctcaagcgattctt

SEQ ID NO: 7456 - DNA, 20 bp, Artificial Sequence
  Description of Artificial Sequence: Synthetic oligonucleotide
cggggctcaagcgattcttg

SEQ ID NO: 7457 - DNA, 20 bp, Artificial Sequence
  Description of Artificial Sequence: Synthetic oligonucleotide
ggggctcaagcgattcttgt

SEQ ID NO: 7458 - DNA, 20 bp, Artificial Sequence
  Description of Artificial Sequence: Synthetic oligonucleotide
gggctcaagcgattcttgtg

SEQ ID NO: 7459 - DNA, 20 bp, Artificial Sequence
  Description of Artificial Sequence: Synthetic oligonucleotide
ggctcaagcgattcttgtgc

SEQ ID NO: 7460 - DNA, 20 bp, Artificial Sequence
  Description of Artificial Sequence: Synthetic oligonucleotide
gctcaagcgattcttgtgct

SEQ ID NO: 7461 - DNA, 20 bp, Artificial Sequence
  Description of Artificial Sequence: Synthetic oligonucleotide
ctcaagcgattcttgtgctt

SEQ ID NO: 7462 - DNA, 20 bp, Artificial Sequence
  Description of Artificial Sequence: Synthetic oligonucleotide
tcaagcgattcttgtgcttc

SEQ ID NO: 7463 - DNA, 20 bp, Artificial Sequence
  Description of Artificial Sequence: Synthetic oligonucleotide
caagcgattcttgtgcttca

SEQ ID NO: 7464 - DNA, 20 bp, Artificial Sequence
  Description of Artificial Sequence: Synthetic oligonucleotide
aagcgattcttgtgcttcag

SEQ ID NO: 7465 - DNA, 20 bp, Artificial Sequence
  Description of Artificial Sequence: Synthetic oligonucleotide
agcgattcttgtgcttcagc

SEQ ID NO: 7466 - DNA, 20 bp, Artificial Sequence
  Description of Artificial Sequence: Synthetic oligonucleotide
gcgattcttgtgcttcagcc

SEQ ID NO: 7467 - DNA, 20 bp, Artificial Sequence
  Description of Artificial Sequence: Synthetic oligonucleotide
cgattcttgtgcttcagccc

SEQ ID NO: 7468 - DNA, 20 bp, Artificial Sequence
  Description of Artificial Sequence: Synthetic oligonucleotide
gattcttgtgcttcagcccc

SEQ ID NO: 7469 - DNA, 20 bp, Artificial Sequence
  Description of Artificial Sequence: Synthetic oligonucleotide
attcttgtgcttcagcccca

SEQ ID NO: 7470 - DNA, 20 bp, Artificial Sequence
  Description of Artificial Sequence: Synthetic oligonucleotide
ttcttgtgcttcagccccac

SEQ ID NO: 7471 - DNA, 20 bp, Artificial Sequence
  Description of Artificial Sequence: Synthetic oligonucleotide
tcttgtgcttcagccccaca

SEQ ID NO: 7472 - DNA, 20 bp, Artificial Sequence
  Description of Artificial Sequence: Synthetic oligonucleotide
cttgtgcttcagccccacaa

SEQ ID NO: 7473 - DNA, 20 bp, Artificial Sequence
  Description of Artificial Sequence: Synthetic oligonucleotide
ttgtgcttcagccccacaag

SEQ ID NO: 7474 - DNA, 20 bp, Artificial Sequence
  Description of Artificial Sequence: Synthetic oligonucleotide
tgtgcttcagccccacaagc

SEQ ID NO: 7475 - DNA, 20 bp, Artificial Sequence
  Description of Artificial Sequence: Synthetic oligonucleotide
gtgcttcagccccacaagca

SEQ ID NO: 7476 - DNA, 20 bp, Artificial Sequence
  Description of Artificial Sequence: Synthetic oligonucleotide
tgcttcagccccacaagcag

SEQ ID NO: 7477 - DNA, 20 bp, Artificial Sequence
  Description of Artificial Sequence: Synthetic oligonucleotide
gcttcagccccacaagcagc

SEQ ID NO: 7478 - DNA, 20 bp, Artificial Sequence
  Description of Artificial Sequence: Synthetic oligonucleotide
cttcagccccacaagcagct

SEQ ID NO: 7479 - DNA, 20 bp, Artificial Sequence
  Description of Artificial Sequence: Synthetic oligonucleotide
ttcagccccacaagcagctg

SEQ ID NO: 7480 - DNA, 20 bp, Artificial Sequence
  Description of Artificial Sequence: Synthetic oligonucleotide
tcagccccacaagcagctgg

SEQ ID NO: 7481 - DNA, 20 bp, Artificial Sequence
  Description of Artificial Sequence: Synthetic oligonucleotide
cagccccacaagcagctgga

SEQ ID NO: 7482 - DNA, 20 bp, Artificial Sequence
  Description of Artificial Sequence: Synthetic oligonucleotide
agccccacaagcagctggaa

SEQ ID NO: 7483 - DNA, 20 bp, Artificial Sequence
  Description of Artificial Sequence: Synthetic oligonucleotide
gccccacaagcagctggaat

SEQ ID NO: 7484 - DNA, 20 bp, Artificial Sequence
  Description of Artificial Sequence: Synthetic oligonucleotide
ccccacaagcagctggaatc

SEQ ID NO: 7485 - DNA, 20 bp, Artificial Sequence
  Description of Artificial Sequence: Synthetic oligonucleotide
cccacaagcagctggaatca

SEQ ID NO: 7486 - DNA, 20 bp, Artificial Sequence
  Description of Artificial Sequence: Synthetic oligonucleotide
ccacaagcagctggaatcac

SEQ ID NO: 7487 - DNA, 20 bp, Artificial Sequence
  Description of Artificial Sequence: Synthetic oligonucleotide
cacaagcagctggaatcaca

SEQ ID NO: 7488 - DNA, 20 bp, Artificial Sequence
  Description of Artificial Sequence: Synthetic oligonucleotide
acaagcagctggaatcacag

SEQ ID NO: 7489 - DNA, 20 bp, Artificial Sequence
  Description of Artificial Sequence: Synthetic oligonucleotide
caagcagctggaatcacagg

SEQ ID NO: 7490 - DNA, 20 bp, Artificial Sequence
  Description of Artificial Sequence: Synthetic oligonucleotide
aagcagctggaatcacaggc

SEQ ID NO: 7491 - DNA, 20 bp, Artificial Sequence
  Description of Artificial Sequence: Synthetic oligonucleotide
agcagctggaatcacaggca

SEQ ID NO: 7492 - DNA, 20 bp, Artificial Sequence
  Description of Artificial Sequence: Synthetic oligonucleotide
gcagctggaatcacaggcac

SEQ ID NO: 7493 - DNA, 20 bp, Artificial Sequence
  Description of Artificial Sequence: Synthetic oligonucleotide
cagctggaatcacaggcacg

SEQ ID NO: 7494 - DNA, 20 bp, Artificial Sequence
  Description of Artificial Sequence: Synthetic oligonucleotide
agctggaatcacaggcacgc

SEQ ID NO: 7495 - DNA, 20 bp, Artificial Sequence
  Description of Artificial Sequence: Synthetic oligonucleotide
gctggaatcacaggcacgcc

SEQ ID NO: 7496 - DNA, 20 bp, Artificial Sequence
  Description of Artificial Sequence: Synthetic oligonucleotide
ctggaatcacaggcacgccc

SEQ ID NO: 7497 - DNA, 20 bp, Artificial Sequence
  Description of Artificial Sequence: Synthetic oligonucleotide
tggaatcacaggcacgcccg

SEQ ID NO: 7498 - DNA, 20 bp, Artificial Sequence
  Description of Artificial Sequence: Synthetic oligonucleotide
ggaatcacaggcacgcccgg

SEQ ID NO: 7499 - DNA, 20 bp, Artificial Sequence
  Description of Artificial Sequence: Synthetic oligonucleotide
gaatcacaggcacgcccggc

SEQ ID NO: 7500 - DNA, 20 bp, Artificial Sequence
  Description of Artificial Sequence: Synthetic oligonucleotide
aatcacaggcacgcccggct

SEQ ID NO: 7501 - DNA, 20 bp, Artificial Sequence
  Description of Artificial Sequence: Synthetic oligonucleotide
atcacaggcacgcccggcta

SEQ ID NO: 7502 - DNA, 20 bp, Artificial Sequence
  Description of Artificial Sequence: Synthetic oligonucleotide
tcacaggcacgcccggctaa

SEQ ID NO: 7503 - DNA, 20 bp, Artificial Sequence
  Description of Artificial Sequence: Synthetic oligonucleotide
cacaggcacgcccggctaat

SEQ ID NO: 7504 - DNA, 20 bp, Artificial Sequence
  Description of Artificial Sequence: Synthetic oligonucleotide
acaggcacgcccggctaatg

SEQ ID NO: 7505 - DNA, 20 bp, Artificial Sequence
  Description of Artificial Sequence: Synthetic oligonucleotide
caggcacgcccggctaatgt

SEQ ID NO: 7506 - DNA, 20 bp, Artificial Sequence
  Description of Artificial Sequence: Synthetic oligonucleotide
aggcacgcccggctaatgtt

SEQ ID NO: 7507 - DNA, 20 bp, Artificial Sequence
  Description of Artificial Sequence: Synthetic oligonucleotide
ggcacgcccggctaatgttt

SEQ ID NO: 7508 - DNA, 20 bp, Artificial Sequence
  Description of Artificial Sequence: Synthetic oligonucleotide
gcacgcccggctaatgttta

SEQ ID NO: 7509 - DNA, 20 bp, Artificial Sequence
  Description of Artificial Sequence: Synthetic oligonucleotide
cacgcccggctaatgtttat

SEQ ID NO: 7510 - DNA, 20 bp, Artificial Sequence
  Description of Artificial Sequence: Synthetic oligonucleotide
acgcccggctaatgtttatg

SEQ ID NO: 7511 - DNA, 20 bp, Artificial Sequence
  Description of Artificial Sequence: Synthetic oligonucleotide
cgcccggctaatgtttatgt

SEQ ID NO: 7512 - DNA, 20 bp, Artificial Sequence
  Description of Artificial Sequence: Synthetic oligonucleotide
gcccggctaatgtttatgtt

SEQ ID NO: 7513 - DNA, 20 bp, Artificial Sequence
  Description of Artificial Sequence: Synthetic oligonucleotide
cccggctaatgtttatgttg

SEQ ID NO: 7514 - DNA, 20 bp, Artificial Sequence
  Description of Artificial Sequence: Synthetic oligonucleotide
ccggctaatgtttatgttgg

SEQ ID NO: 7515 - DNA, 20 bp, Artificial Sequence
  Description of Artificial Sequence: Synthetic oligonucleotide
cggctaatgtttatgttggt

SEQ ID NO: 7516 - DNA, 20 bp, Artificial Sequence
  Description of Artificial Sequence: Synthetic oligonucleotide
ggctaatgtttatgttggta

SEQ ID NO: 7517 - DNA, 20 bp, Artificial Sequence
  Description of Artificial Sequence: Synthetic oligonucleotide
gctaatgtttatgttggtag

SEQ ID NO: 7518 - DNA, 20 bp, Artificial Sequence
  Description of Artificial Sequence: Synthetic oligonucleotide
ctaatgtttatgttggtaga

SEQ ID NO: 7519 - DNA, 20 bp, Artificial Sequence
  Description of Artificial Sequence: Synthetic oligonucleotide
taatgtttatgttggtagag

SEQ ID NO: 7520 - DNA, 20 bp, Artificial Sequence
  Description of Artificial Sequence: Synthetic oligonucleotide
aatgtttatgttggtagaga

SEQ ID NO: 7521 - DNA, 20 bp, Artificial Sequence
  Description of Artificial Sequence: Synthetic oligonucleotide
atgtttatgttggtagagat

SEQ ID NO: 7522 - DNA, 20 bp, Artificial Sequence
  Description of Artificial Sequence: Synthetic oligonucleotide
tgtttatgttggtagagata

SEQ ID NO: 7523 - DNA, 20 bp, Artificial Sequence
  Description of Artificial Sequence: Synthetic oligonucleotide
gtttatgttggtagagatag

SEQ ID NO: 7524 - DNA, 20 bp, Artificial Sequence
  Description of Artificial Sequence: Synthetic oligonucleotide
tttatgttggtagagatagg

SEQ ID NO: 7525 - DNA, 20 bp, Artificial Sequence
  Description of Artificial Sequence: Synthetic oligonucleotide
ttatgttggtagagataggg

SEQ ID NO: 7526 - DNA, 20 bp, Artificial Sequence
  Description of Artificial Sequence: Synthetic oligonucleotide
tatgttggtagagatagggt

SEQ ID NO: 7527 - DNA, 20 bp, Artificial Sequence
  Description of Artificial Sequence: Synthetic oligonucleotide
atgttggtagagatagggtt

SEQ ID NO: 7528 - DNA, 20 bp, Artificial Sequence
  Description of Artificial Sequence: Synthetic oligonucleotide
tgttggtagagatagggttt

SEQ ID NO: 7529 - DNA, 20 bp, Artificial Sequence
  Description of Artificial Sequence: Synthetic oligonucleotide
gttggtagagatagggtttc

SEQ ID NO: 7530 - DNA, 20 bp, Artificial Sequence
  Description of Artificial Sequence: Synthetic oligonucleotide
ttggtagagatagggtttca

SEQ ID NO: 7531 - DNA, 20 bp, Artificial Sequence
  Description of Artificial Sequence: Synthetic oligonucleotide
tggtagagatagggtttcac

SEQ ID NO: 7532 - DNA, 20 bp, Artificial Sequence
  Description of Artificial Sequence: Synthetic oligonucleotide
ggtagagatagggtttcacc

SEQ ID NO: 7533 - DNA, 20 bp, Artificial Sequence
  Description of Artificial Sequence: Synthetic oligonucleotide
gtagagatagggtttcacca

SEQ ID NO: 7534 - DNA, 20 bp, Artificial Sequence
  Description of Artificial Sequence: Synthetic oligonucleotide
tagagatagggtttcaccat

SEQ ID NO: 7535 - DNA, 20 bp, Artificial Sequence
  Description of Artificial Sequence: Synthetic oligonucleotide
agagatagggtttcaccatg

SEQ ID NO: 7536 - DNA, 20 bp, Artificial Sequence
  Description of Artificial Sequence: Synthetic oligonucleotide
gagatagggtttcaccatgt

SEQ ID NO: 7537 - DNA, 20 bp, Artificial Sequence
  Description of Artificial Sequence: Synthetic oligonucleotide
agatagggtttcaccatgtt

SEQ ID NO: 7538 - DNA, 20 bp, Artificial Sequence
  Description of Artificial Sequence: Synthetic oligonucleotide
gatagggtttcaccatgttg

SEQ ID NO: 7539 - DNA, 20 bp, Artificial Sequence
  Description of Artificial Sequence: Synthetic oligonucleotide
atagggtttcaccatgttgg

SEQ ID NO: 7540 - DNA, 20 bp, Artificial Sequence
  Description of Artificial Sequence: Synthetic oligonucleotide
tagggtttcaccatgttggc

SEQ ID NO: 7541 - DNA, 20 bp, Artificial Sequence
  Description of Artificial Sequence: Synthetic oligonucleotide
agggtttcaccatgttggcc

SEQ ID NO: 7542 - DNA, 20 bp, Artificial Sequence
  Description of Artificial Sequence: Synthetic oligonucleotide
gggtttcaccatgttggcca

SEQ ID NO: 7543 - DNA, 20 bp, Artificial Sequence
  Description of Artificial Sequence: Synthetic oligonucleotide
ggtttcaccatgttggccag

SEQ ID NO: 7544 - DNA, 20 bp, Artificial Sequence
  Description of Artificial Sequence: Synthetic oligonucleotide
gtttcaccatgttggccagg

SEQ ID NO: 7545 - DNA, 20 bp, Artificial Sequence
  Description of Artificial Sequence: Synthetic oligonucleotide
tttcaccatgttggccaggc

SEQ ID NO: 7546 - DNA, 20 bp, Artificial Sequence
  Description of Artificial Sequence: Synthetic oligonucleotide
ttcaccatgttggccaggct

SEQ ID NO: 7547 - DNA, 20 bp, Artificial Sequence
  Description of Artificial Sequence: Synthetic oligonucleotide
tcaccatgttggccaggctg

SEQ ID NO: 7548 - DNA, 20 bp, Artificial Sequence
  Description of Artificial Sequence: Synthetic oligonucleotide
caccatgttggccaggctgg

SEQ ID NO: 7549 - DNA, 20 bp, Artificial Sequence
  Description of Artificial Sequence: Synthetic oligonucleotide
accatgttggccaggctggt

SEQ ID NO: 7550 - DNA, 20 bp, Artificial Sequence
  Description of Artificial Sequence: Synthetic oligonucleotide
ccatgttggccaggctggtc

SEQ ID NO: 7551 - DNA, 20 bp, Artificial Sequence
  Description of Artificial Sequence: Synthetic oligonucleotide
catgttggccaggctggtct

SEQ ID NO: 7552 - DNA, 20 bp, Artificial Sequence
  Description of Artificial Sequence: Synthetic oligonucleotide
atgttggccaggctggtctt

SEQ ID NO: 7553 - DNA, 20 bp, Artificial Sequence
  Description of Artificial Sequence: Synthetic oligonucleotide
tgttggccaggctggtcttg

SEQ ID NO: 7554 - DNA, 20 bp, Artificial Sequence
  Description of Artificial Sequence: Synthetic oligonucleotide
gttggccaggctggtcttga

SEQ ID NO: 7555 - DNA, 20 bp, Artificial Sequence
  Description of Artificial Sequence: Synthetic oligonucleotide
ttggccaggctggtcttgaa

SEQ ID NO: 7556 - DNA, 20 bp, Artificial Sequence
  Description of Artificial Sequence: Synthetic oligonucleotide
tggccaggctggtcttgaac

SEQ ID NO: 7557 - DNA, 20 bp, Artificial Sequence
  Description of Artificial Sequence: Synthetic oligonucleotide
ggccaggctggtcttgaact

SEQ ID NO: 7558 - DNA, 20 bp, Artificial Sequence
  Description of Artificial Sequence: Synthetic oligonucleotide
gccaggctggtcttgaactt

SEQ ID NO: 7559 - DNA, 20 bp, Artificial Sequence
  Description of Artificial Sequence: Synthetic oligonucleotide
ccaggctggtcttgaacttc

SEQ ID NO: 7560 - DNA, 20 bp, Artificial Sequence
  Description of Artificial Sequence: Synthetic oligonucleotide
caggctggtcttgaacttct

SEQ ID NO: 7561 - DNA, 20 bp, Artificial Sequence
  Description of Artificial Sequence: Synthetic oligonucleotide
aggctggtcttgaacttctg

SEQ ID NO: 7562 - DNA, 20 bp, Artificial Sequence
  Description of Artificial Sequence: Synthetic oligonucleotide
ggctggtcttgaacttctga

SEQ ID NO: 7563 - DNA, 20 bp, Artificial Sequence
  Description of Artificial Sequence: Synthetic oligonucleotide
gctggtcttgaacttctgac

SEQ ID NO: 7564 - DNA, 20 bp, Artificial Sequence
  Description of Artificial Sequence: Synthetic oligonucleotide
ctggtcttgaacttctgacc

SEQ ID NO: 7565 - DNA, 20 bp, Artificial Sequence
  Description of Artificial Sequence: Synthetic oligonucleotide
tggtcttgaacttctgacct

SEQ ID NO: 7566 - DNA, 20 bp, Artificial Sequence
  Description of Artificial Sequence: Synthetic oligonucleotide
ggtcttgaacttctgacctc

SEQ ID NO: 7567 - DNA, 20 bp, Artificial Sequence
  Description of Artificial Sequence: Synthetic oligonucleotide
gtcttgaacttctgacctca

SEQ ID NO: 7568 - DNA, 20 bp, Artificial Sequence
  Description of Artificial Sequence: Synthetic oligonucleotide
tcttgaacttctgacctcaa

SEQ ID NO: 7569 - DNA, 20 bp, Artificial Sequence
  Description of Artificial Sequence: Synthetic oligonucleotide
cttgaacttctgacctcaag

SEQ ID NO: 7570 - DNA, 20 bp, Artificial Sequence
  Description of Artificial Sequence: Synthetic oligonucleotide
ttgaacttctgacctcaagt

SEQ ID NO: 7571 - DNA, 20 bp, Artificial Sequence
  Description of Artificial Sequence: Synthetic oligonucleotide
tgaacttctgacctcaagtg

SEQ ID NO: 7572 - DNA, 20 bp, Artificial Sequence
  Description of Artificial Sequence: Synthetic oligonucleotide
gaacttctgacctcaagtga

SEQ ID NO: 7573 - DNA, 20 bp, Artificial Sequence
  Description of Artificial Sequence: Synthetic oligonucleotide
aacttctgacctcaagtgat

SEQ ID NO: 7574 - DNA, 20 bp, Artificial Sequence
  Description of Artificial Sequence: Synthetic oligonucleotide
acttctgacctcaagtgatt

SEQ ID NO: 7575 - DNA, 20 bp, Artificial Sequence
  Description of Artificial Sequence: Synthetic oligonucleotide
cttctgacctcaagtgattt

SEQ ID NO: 7576 - DNA, 20 bp, Artificial Sequence
  Description of Artificial Sequence: Synthetic oligonucleotide
ttctgacctcaagtgatttg

SEQ ID NO: 7577 - DNA, 20 bp, Artificial Sequence
  Description of Artificial Sequence: Synthetic oligonucleotide
tctgacctcaagtgatttgc

SEQ ID NO: 7578 - DNA, 20 bp, Artificial Sequence
  Description of Artificial Sequence: Synthetic oligonucleotide
ctgacctcaagtgatttgcc

SEQ ID NO: 7579 - DNA, 20 bp, Artificial Sequence
  Description of Artificial Sequence: Synthetic oligonucleotide
tgacctcaagtgatttgccc

SEQ ID NO: 7580 - DNA, 20 bp, Artificial Sequence
  Description of Artificial Sequence: Synthetic oligonucleotide
gacctcaagtgatttgcccg

SEQ ID NO: 7581 - DNA, 20 bp, Artificial Sequence
  Description of Artificial Sequence: Synthetic oligonucleotide
acctcaagtgatttgcccgc

SEQ ID NO: 7582 - DNA, 20 bp, Artificial Sequence
  Description of Artificial Sequence: Synthetic oligonucleotide
cctcaagtgatttgcccgcc

SEQ ID NO: 7583 - DNA, 20 bp, Artificial Sequence
  Description of Artificial Sequence: Synthetic oligonucleotide
ctcaagtgatttgcccgcct

SEQ ID NO: 7584 - DNA, 20 bp, Artificial Sequence
  Description of Artificial Sequence: Synthetic oligonucleotide
tcaagtgatttgcccgcctc

SEQ ID NO: 7585 - DNA, 20 bp, Artificial Sequence
  Description of Artificial Sequence: Synthetic oligonucleotide
caagtgatttgcccgcctca

SEQ ID NO: 7586 - DNA, 20 bp, Artificial Sequence
  Description of Artificial Sequence: Synthetic oligonucleotide
aagtgatttgcccgcctcag

SEQ ID NO: 7587 - DNA, 20 bp, Artificial Sequence
  Description of Artificial Sequence: Synthetic oligonucleotide
agtgatttgcccgcctcagc

SEQ ID NO: 7588 - DNA, 20 bp, Artificial Sequence
  Description of Artificial Sequence: Synthetic oligonucleotide
gtgatttgcccgcctcagcc

SEQ ID NO: 7589 - DNA, 20 bp, Artificial Sequence
  Description of Artificial Sequence: Synthetic oligonucleotide
tgatttgcccgcctcagcct

SEQ ID NO: 7590 - DNA, 20 bp, Artificial Sequence
  Description of Artificial Sequence: Synthetic oligonucleotide
gatttgcccgcctcagcctc

SEQ ID NO: 7591 - DNA, 20 bp, Artificial Sequence
  Description of Artificial Sequence: Synthetic oligonucleotide
atttgcccgcctcagcctcc

SEQ ID NO: 7592 - DNA, 20 bp, Artificial Sequence
  Description of Artificial Sequence: Synthetic oligonucleotide
tttgcccgcctcagcctccc

SEQ ID NO: 7593 - DNA, 20 bp, Artificial Sequence
  Description of Artificial Sequence: Synthetic oligonucleotide
ttgcccgcctcagcctccca

SEQ ID NO: 7594 - DNA, 20 bp, Artificial Sequence
  Description of Artificial Sequence: Synthetic oligonucleotide
tgcccgcctcagcctcccaa

SEQ ID NO: 7595 - DNA, 20 bp, Artificial Sequence
  Description of Artificial Sequence: Synthetic oligonucleotide
gcccgcctcagcctcccaaa

SEQ ID NO: 7596 - DNA, 20 bp, Artificial Sequence
  Description of Artificial Sequence: Synthetic oligonucleotide
cccgcctcagcctcccaaag

SEQ ID NO: 7597 - DNA, 20 bp, Artificial Sequence
  Description of Artificial Sequence: Synthetic oligonucleotide
ccgcctcagcctcccaaagt

SEQ ID NO: 7598 - DNA, 20 bp, Artificial Sequence
  Description of Artificial Sequence: Synthetic oligonucleotide
cgcctcagcctcccaaagtg

SEQ ID NO: 7599 - DNA, 20 bp, Artificial Sequence
  Description of Artificial Sequence: Synthetic oligonucleotide
gcctcagcctcccaaagtgc

SEQ ID NO: 7600 - DNA, 20 bp, Artificial Sequence
  Description of Artificial Sequence: Synthetic oligonucleotide
cctcagcctcccaaagtgct

SEQ ID NO: 7601 - DNA, 20 bp, Artificial Sequence
  Description of Artificial Sequence: Synthetic oligonucleotide
ctcagcctcccaaagtgctg

SEQ ID NO: 7602 - DNA, 20 bp, Artificial Sequence
  Description of Artificial Sequence: Synthetic oligonucleotide
tcagcctcccaaagtgctgg

SEQ ID NO: 7603 - DNA, 20 bp, Artificial Sequence
  Description of Artificial Sequence: Synthetic oligonucleotide
cagcctcccaaagtgctggc

SEQ ID NO: 7604 - DNA, 20 bp, Artificial Sequence
  Description of Artificial Sequence: Synthetic oligonucleotide
agcctcccaaagtgctggca

SEQ ID NO: 7605 - DNA, 20 bp, Artificial Sequence
  Description of Artificial Sequence: Synthetic oligonucleotide
gcctcccaaagtgctggcat

SEQ ID NO: 7606 - DNA, 20 bp, Artificial Sequence
  Description of Artificial Sequence: Synthetic oligonucleotide
cctcccaaagtgctggcatt

SEQ ID NO: 7607 - DNA, 20 bp, Artificial Sequence
  Description of Artificial Sequence: Synthetic oligonucleotide
ctcccaaagtgctggcattt

SEQ ID NO: 7608 - DNA, 20 bp, Artificial Sequence
  Description of Artificial Sequence: Synthetic oligonucleotide
tcccaaagtgctggcatttc

SEQ ID NO: 7609 - DNA, 20 bp, Artificial Sequence
  Description of Artificial Sequence: Synthetic oligonucleotide
cccaaagtgctggcatttca

SEQ ID NO: 7610 - DNA, 20 bp, Artificial Sequence
  Description of Artificial Sequence: Synthetic oligonucleotide
ccaaagtgctggcatttcag

SEQ ID NO: 7611 - DNA, 20 bp, Artificial Sequence
  Description of Artificial Sequence: Synthetic oligonucleotide
caaagtgctggcatttcagg

SEQ ID NO: 7612 - DNA, 20 bp, Artificial Sequence
  Description of Artificial Sequence: Synthetic oligonucleotide
aaagtgctggcatttcaggt

SEQ ID NO: 7613 - DNA, 20 bp, Artificial Sequence
  Description of Artificial Sequence: Synthetic oligonucleotide
aagtgctggcatttcaggtg

SEQ ID NO: 7614 - DNA, 20 bp, Artificial Sequence
  Description of Artificial Sequence: Synthetic oligonucleotide
agtgctggcatttcaggtgt

SEQ ID NO: 7615 - DNA, 20 bp, Artificial Sequence
  Description of Artificial Sequence: Synthetic oligonucleotide
gtgctggcatttcaggtgta

SEQ ID NO: 7616 - DNA, 20 bp, Artificial Sequence
  Description of Artificial Sequence: Synthetic oligonucleotide
tgctggcatttcaggtgtaa

SEQ ID NO: 7617 - DNA, 20 bp, Artificial Sequence
  Description of Artificial Sequence: Synthetic oligonucleotide
gctggcatttcaggtgtaag

SEQ ID NO: 7618 - DNA, 20 bp, Artificial Sequence
  Description of Artificial Sequence: Synthetic oligonucleotide
ctggcatttcaggtgtaagc

SEQ ID NO: 7619 - DNA, 20 bp, Artificial Sequence
  Description of Artificial Sequence: Synthetic oligonucleotide
tggcatttcaggtgtaagcc

SEQ ID NO: 7620 - DNA, 20 bp, Artificial Sequence
  Description of Artificial Sequence: Synthetic oligonucleotide
ggcatttcaggtgtaagcca

SEQ ID NO: 7621 - DNA, 20 bp, Artificial Sequence
  Description of Artificial Sequence: Synthetic oligonucleotide
gcatttcaggtgtaagccac

SEQ ID NO: 7622 - DNA, 20 bp, Artificial Sequence
  Description of Artificial Sequence: Synthetic oligonucleotide
catttcaggtgtaagccacc

SEQ ID NO: 7623 - DNA, 20 bp, Artificial Sequence
  Description of Artificial Sequence: Synthetic oligonucleotide
atttcaggtgtaagccaccg

SEQ ID NO: 7624 - DNA, 20 bp, Artificial Sequence
  Description of Artificial Sequence: Synthetic oligonucleotide
tttcaggtgtaagccaccgt

SEQ ID NO: 7625 - DNA, 20 bp, Artificial Sequence
  Description of Artificial Sequence: Synthetic oligonucleotide
ttcaggtgtaagccaccgtg

SEQ ID NO: 7626 - DNA, 20 bp, Artificial Sequence
  Description of Artificial Sequence: Synthetic oligonucleotide
tcaggtgtaagccaccgtgc

SEQ ID NO: 7627 - DNA, 20 bp, Artificial Sequence
  Description of Artificial Sequence: Synthetic oligonucleotide
caggtgtaagccaccgtgct

SEQ ID NO: 7628 - DNA, 20 bp, Artificial Sequence
  Description of Artificial Sequence: Synthetic oligonucleotide
aggtgtaagccaccgtgctc

SEQ ID NO: 7629 - DNA, 20 bp, Artificial Sequence
  Description of Artificial Sequence: Synthetic oligonucleotide
ggtgtaagccaccgtgctca

SEQ ID NO: 7630 - DNA, 20 bp, Artificial Sequence
  Description of Artificial Sequence: Synthetic oligonucleotide
gtgtaagccaccgtgctcag

SEQ ID NO: 7631 - DNA, 20 bp, Artificial Sequence
  Description of Artificial Sequence: Synthetic oligonucleotide
tgtaagccaccgtgctcagc

SEQ ID NO: 7632 - DNA, 20 bp, Artificial Sequence
  Description of Artificial Sequence: Synthetic oligonucleotide
gtaagccaccgtgctcagcc

SEQ ID NO: 7633 - DNA, 20 bp, Artificial Sequence
  Description of Artificial Sequence: Synthetic oligonucleotide
taagccaccgtgctcagcct

SEQ ID NO: 7634 - DNA, 20 bp, Artificial Sequence
  Description of Artificial Sequence: Synthetic oligonucleotide
aagccaccgtgctcagcctt

SEQ ID NO: 7635 - DNA, 20 bp, Artificial Sequence
  Description of Artificial Sequence: Synthetic oligonucleotide
agccaccgtgctcagccttt

SEQ ID NO: 7636 - DNA, 20 bp, Artificial Sequence
  Description of Artificial Sequence: Synthetic oligonucleotide
gccaccgtgctcagcctttg

SEQ ID NO: 7637 - DNA, 20 bp, Artificial Sequence
  Description of Artificial Sequence: Synthetic oligonucleotide
ccaccgtgctcagcctttgt

SEQ ID NO: 7638 - DNA, 20 bp, Artificial Sequence
  Description of Artificial Sequence: Synthetic oligonucleotide
caccgtgctcagcctttgtt

SEQ ID NO: 7639 - DNA, 20 bp, Artificial Sequence
  Description of Artificial Sequence: Synthetic oligonucleotide
accgtgctcagcctttgttt

SEQ ID NO: 7640 - DNA, 20 bp, Artificial Sequence
  Description of Artificial Sequence: Synthetic oligonucleotide
ccgtgctcagcctttgtttt

SEQ ID NO: 7641 - DNA, 20 bp, Artificial Sequence
  Description of Artificial Sequence: Synthetic oligonucleotide
cgtgctcagcctttgttttt

SEQ ID NO: 7642 - DNA, 20 bp, Artificial Sequence
  Description of Artificial Sequence: Synthetic oligonucleotide
gtgctcagcctttgtttttt

SEQ ID NO: 7643 - DNA, 20 bp, Artificial Sequence
  Description of Artificial Sequence: Synthetic oligonucleotide
tgctcagcctttgttttttt

SEQ ID NO: 7644 - DNA, 20 bp, Artificial Sequence
  Description of Artificial Sequence: Synthetic oligonucleotide
gctcagcctttgtttttttt

SEQ ID NO: 7645 - DNA, 20 bp, Artificial Sequence
  Description of Artificial Sequence: Synthetic oligonucleotide
ctcagcctttgttttttttt

SEQ ID NO: 7646 - DNA, 20 bp, Artificial Sequence
  Description of Artificial Sequence: Synthetic oligonucleotide
tcagcctttgttttttttta

SEQ ID NO: 7647 - DNA, 20 bp, Artificial Sequence
  Description of Artificial Sequence: Synthetic oligonucleotide
cagcctttgtttttttttag

SEQ ID NO: 7648 - DNA, 20 bp, Artificial Sequence
  Description of Artificial Sequence: Synthetic oligonucleotide
agcctttgtttttttttaga

SEQ ID NO: 7649 - DNA, 20 bp, Artificial Sequence
  Description of Artificial Sequence: Synthetic oligonucleotide
gcctttgtttttttttagaa

SEQ ID NO: 7650 - DNA, 20 bp, Artificial Sequence
  Description of Artificial Sequence: Synthetic oligonucleotide
cctttgtttttttttagaaa

SEQ ID NO: 7651 - DNA, 20 bp, Artificial Sequence
  Description of Artificial Sequence: Synthetic oligonucleotide
ctttgtttttttttagaaac

SEQ ID NO: 7652 - DNA, 20 bp, Artificial Sequence
  Description of Artificial Sequence: Synthetic oligonucleotide
tttgtttttttttagaaacg

SEQ ID NO: 7653 - DNA, 20 bp, Artificial Sequence
  Description of Artificial Sequence: Synthetic oligonucleotide
ttgtttttttttagaaacga

SEQ ID NO: 7654 - DNA, 20 bp, Artificial Sequence
  Description of Artificial Sequence: Synthetic oligonucleotide
tgtttttttttagaaacgag

SEQ ID NO: 7655 - DNA, 20 bp, Artificial Sequence
  Description of Artificial Sequence: Synthetic oligonucleotide
gtttttttttagaaacgagg

SEQ ID NO: 7656 - DNA, 20 bp, Artificial Sequence
  Description of Artificial Sequence: Synthetic oligonucleotide
tttttttttagaaacgaggt

SEQ ID NO: 7657 - DNA, 20 bp, Artificial Sequence
  Description of Artificial Sequence: Synthetic oligonucleotide
ttttttttagaaacgaggtt

SEQ ID NO: 7658 - DNA, 20 bp, Artificial Sequence
  Description of Artificial Sequence: Synthetic oligonucleotide
tttttttagaaacgaggttt

SEQ ID NO: 7659 - DNA, 20 bp, Artificial Sequence
  Description of Artificial Sequence: Synthetic oligonucleotide
ttttttagaaacgaggtttt

SEQ ID NO: 7660 - DNA, 20 bp, Artificial Sequence
  Description of Artificial Sequence: Synthetic oligonucleotide
tttttagaaacgaggttttg

SEQ ID NO: 7661 - DNA, 20 bp, Artificial Sequence
  Description of Artificial Sequence: Synthetic oligonucleotide
ttttagaaacgaggttttgt

SEQ ID NO: 7662 - DNA, 20 bp, Artificial Sequence
  Description of Artificial Sequence: Synthetic oligonucleotide
tttagaaacgaggttttgtt

SEQ ID NO: 7663 - DNA, 20 bp, Artificial Sequence
  Description of Artificial Sequence: Synthetic oligonucleotide
ttagaaacgaggttttgttg

SEQ ID NO: 7664 - DNA, 20 bp, Artificial Sequence
  Description of Artificial Sequence: Synthetic oligonucleotide
tagaaacgaggttttgttgt

SEQ ID NO: 7665 - DNA, 20 bp, Artificial Sequence
  Description of Artificial Sequence: Synthetic oligonucleotide
agaaacgaggttttgttgtg

SEQ ID NO: 7666 - DNA, 20 bp, Artificial Sequence
  Description of Artificial Sequence: Synthetic oligonucleotide
gaaacgaggttttgttgtgt

SEQ ID NO: 7667 - DNA, 20 bp, Artificial Sequence
  Description of Artificial Sequence: Synthetic oligonucleotide
aaacgaggttttgttgtgtt

SEQ ID NO: 7668 - DNA, 20 bp, Artificial Sequence
  Description of Artificial Sequence: Synthetic oligonucleotide
aacgaggttttgttgtgttg

SEQ ID NO: 7669 - DNA, 20 bp, Artificial Sequence
  Description of Artificial Sequence: Synthetic oligonucleotide
acgaggttttgttgtgttgc

SEQ ID NO: 7670 - DNA, 20 bp, Artificial Sequence
  Description of Artificial Sequence: Synthetic oligonucleotide
cgaggttttgttgtgttgcc

SEQ ID NO: 7671 - DNA, 20 bp, Artificial Sequence
  Description of Artificial Sequence: Synthetic oligonucleotide
gaggttttgttgtgttgccc

SEQ ID NO: 7672 - DNA, 20 bp, Artificial Sequence
  Description of Artificial Sequence: Synthetic oligonucleotide
aggttttgttgtgttgccca

SEQ ID NO: 7673 - DNA, 20 bp, Artificial Sequence
  Description of Artificial Sequence: Synthetic oligonucleotide
ggttttgttgtgttgcccag

SEQ ID NO: 7674 - DNA, 20 bp, Artificial Sequence
  Description of Artificial Sequence: Synthetic oligonucleotide
gttttgttgtgttgcccagg

SEQ ID NO: 7675 - DNA, 20 bp, Artificial Sequence
  Description of Artificial Sequence: Synthetic oligonucleotide
ttttgttgtgttgcccaggt

SEQ ID NO: 7676 - DNA, 20 bp, Artificial Sequence
  Description of Artificial Sequence: Synthetic oligonucleotide
tttgttgtgttgcccaggtt

SEQ ID NO: 7677 - DNA, 20 bp, Artificial Sequence
  Description of Artificial Sequence: Synthetic oligonucleotide
ttgttgtgttgcccaggttg

SEQ ID NO: 7678 - DNA, 20 bp, Artificial Sequence
  Description of Artificial Sequence: Synthetic oligonucleotide
tgttgtgttgcccaggttgg

SEQ ID NO: 7679 - DNA, 20 bp, Artificial Sequence
  Description of Artificial Sequence: Synthetic oligonucleotide
gttgtgttgcccaggttgga

SEQ ID NO: 7680 - DNA, 20 bp, Artificial Sequence
  Description of Artificial Sequence: Synthetic oligonucleotide
ttgtgttgcccaggttggag

SEQ ID NO: 7681 - DNA, 20 bp, Artificial Sequence
  Description of Artificial Sequence: Synthetic oligonucleotide
tgtgttgcccaggttggagt

SEQ ID NO: 7682 - DNA, 20 bp, Artificial Sequence
  Description of Artificial Sequence: Synthetic oligonucleotide
gtgttgcccaggttggagtg

SEQ ID NO: 7683 - DNA, 20 bp, Artificial Sequence
  Description of Artificial Sequence: Synthetic oligonucleotide
tgttgcccaggttggagtgc

SEQ ID NO: 7684 - DNA, 20 bp, Artificial Sequence
  Description of Artificial Sequence: Synthetic oligonucleotide
gttgcccaggttggagtgcg

SEQ ID NO: 7685 - DNA, 20 bp, Artificial Sequence
  Description of Artificial Sequence: Synthetic oligonucleotide
ttgcccaggttggagtgcgg

SEQ ID NO: 7686 - DNA, 20 bp, Artificial Sequence
  Description of Artificial Sequence: Synthetic oligonucleotide
tgcccaggttggagtgcggt

SEQ ID NO: 7687 - DNA, 20 bp, Artificial Sequence
  Description of Artificial Sequence: Synthetic oligonucleotide
gcccaggttggagtgcggtg

SEQ ID NO: 7688 - DNA, 20 bp, Artificial Sequence
  Description of Artificial Sequence: Synthetic oligonucleotide
cccaggttggagtgcggtgg

SEQ ID NO: 7689 - DNA, 20 bp, Artificial Sequence
  Description of Artificial Sequence: Synthetic oligonucleotide
ccaggttggagtgcggtggc

SEQ ID NO: 7690 - DNA, 20 bp, Artificial Sequence
  Description of Artificial Sequence: Synthetic oligonucleotide
caggttggagtgcggtggct

SEQ ID NO: 7691 - DNA, 20 bp, Artificial Sequence
  Description of Artificial Sequence: Synthetic oligonucleotide
aggttggagtgcggtggcta

SEQ ID NO: 7692 - DNA, 20 bp, Artificial Sequence
  Description of Artificial Sequence: Synthetic oligonucleotide
ggttggagtgcggtggctat

SEQ ID NO: 7693 - DNA, 20 bp, Artificial Sequence
  Description of Artificial Sequence: Synthetic oligonucleotide
gttggagtgcggtggctatt

SEQ ID NO: 7694 - DNA, 20 bp, Artificial Sequence
  Description of Artificial Sequence: Synthetic oligonucleotide
ttggagtgcggtggctattc

SEQ ID NO: 7695 - DNA, 20 bp, Artificial Sequence
  Description of Artificial Sequence: Synthetic oligonucleotide
tggagtgcggtggctattca

SEQ ID NO: 7696 - DNA, 20 bp, Artificial Sequence
  Description of Artificial Sequence: Synthetic oligonucleotide
ggagtgcggtggctattcac

SEQ ID NO: 7697 - DNA, 20 bp, Artificial Sequence
  Description of Artificial Sequence: Synthetic oligonucleotide
gagtgcggtggctattcaca

SEQ ID NO: 7698 - DNA, 20 bp, Artificial Sequence
  Description of Artificial Sequence: Synthetic oligonucleotide
agtgcggtggctattcacag

SEQ ID NO: 7699 - DNA, 20 bp, Artificial Sequence
  Description of Artificial Sequence: Synthetic oligonucleotide
gtgcggtggctattcacagg

SEQ ID NO: 7700 - DNA, 20 bp, Artificial Sequence
  Description of Artificial Sequence: Synthetic oligonucleotide
tgcggtggctattcacaggt

SEQ ID NO: 7701 - DNA, 20 bp, Artificial Sequence
  Description of Artificial Sequence: Synthetic oligonucleotide
gcggtggctattcacaggtg

SEQ ID NO: 7702 - DNA, 20 bp, Artificial Sequence
  Description of Artificial Sequence: Synthetic oligonucleotide
cggtggctattcacaggtgt

SEQ ID NO: 7703 - DNA, 20 bp, Artificial Sequence
  Description of Artificial Sequence: Synthetic oligonucleotide
ggtggctattcacaggtgtg

SEQ ID NO: 7704 - DNA, 20 bp, Artificial Sequence
  Description of Artificial Sequence: Synthetic oligonucleotide
gtggctattcacaggtgtga

SEQ ID NO: 7705 - DNA, 20 bp, Artificial Sequence
  Description of Artificial Sequence: Synthetic oligonucleotide
tggctattcacaggtgtgat

SEQ ID NO: 7706 - DNA, 20 bp, Artificial Sequence
  Description of Artificial Sequence: Synthetic oligonucleotide
ggctattcacaggtgtgatc

SEQ ID NO: 7707 - DNA, 20 bp, Artificial Sequence
  Description of Artificial Sequence: Synthetic oligonucleotide
gctattcacaggtgtgatca

SEQ ID NO: 7708 - DNA, 20 bp, Artificial Sequence
  Description of Artificial Sequence: Synthetic oligonucleotide
ctattcacaggtgtgatcac

SEQ ID NO: 7709 - DNA, 20 bp, Artificial Sequence
  Description of Artificial Sequence: Synthetic oligonucleotide
tattcacaggtgtgatcacg

SEQ ID NO: 7710 - DNA, 20 bp, Artificial Sequence
  Description of Artificial Sequence: Synthetic oligonucleotide
attcacaggtgtgatcacgg

SEQ ID NO: 7711 - DNA, 20 bp, Artificial Sequence
  Description of Artificial Sequence: Synthetic oligonucleotide
ttcacaggtgtgatcacggc

SEQ ID NO: 7712 - DNA, 20 bp, Artificial Sequence
  Description of Artificial Sequence: Synthetic oligonucleotide
tcacaggtgtgatcacggct

SEQ ID NO: 7713 - DNA, 20 bp, Artificial Sequence
  Description of Artificial Sequence: Synthetic oligonucleotide
cacaggtgtgatcacggctc

SEQ ID NO: 7714 - DNA, 20 bp, Artificial Sequence
  Description of Artificial Sequence: Synthetic oligonucleotide
acaggtgtgatcacggctca

SEQ ID NO: 7715 - DNA, 20 bp, Artificial Sequence
  Description of Artificial Sequence: Synthetic oligonucleotide
caggtgtgatcacggctcac

SEQ ID NO: 7716 - DNA, 20 bp, Artificial Sequence
  Description of Artificial Sequence: Synthetic oligonucleotide
aggtgtgatcacggctcacg

SEQ ID NO: 7717 - DNA, 20 bp, Artificial Sequence
  Description of Artificial Sequence: Synthetic oligonucleotide
ggtgtgatcacggctcacgg

SEQ ID NO: 7718 - DNA, 20 bp, Artificial Sequence
  Description of Artificial Sequence: Synthetic oligonucleotide
gtgtgatcacggctcacggc

SEQ ID NO: 7719 - DNA, 20 bp, Artificial Sequence
  Description of Artificial Sequence: Synthetic oligonucleotide
tgtgatcacggctcacggca

SEQ ID NO: 7720 - DNA, 20 bp, Artificial Sequence
  Description of Artificial Sequence: Synthetic oligonucleotide
gtgatcacggctcacggcag

SEQ ID NO: 7721 - DNA, 20 bp, Artificial Sequence
  Description of Artificial Sequence: Synthetic oligonucleotide
tgatcacggctcacggcagc

SEQ ID NO: 7722 - DNA, 20 bp, Artificial Sequence
  Description of Artificial Sequence: Synthetic oligonucleotide
gatcacggctcacggcagcc

SEQ ID NO: 7723 - DNA, 20 bp, Artificial Sequence
  Description of Artificial Sequence: Synthetic oligonucleotide
atcacggctcacggcagcct

SEQ ID NO: 7724 - DNA, 20 bp, Artificial Sequence
  Description of Artificial Sequence: Synthetic oligonucleotide
tcacggctcacggcagcctt

SEQ ID NO: 7725 - DNA, 20 bp, Artificial Sequence
  Description of Artificial Sequence: Synthetic oligonucleotide
cacggctcacggcagccttt

SEQ ID NO: 7726 - DNA, 20 bp, Artificial Sequence
  Description of Artificial Sequence: Synthetic oligonucleotide
acggctcacggcagccttta

SEQ ID NO: 7727 - DNA, 20 bp, Artificial Sequence
  Description of Artificial Sequence: Synthetic oligonucleotide
cggctcacggcagcctttaa

SEQ ID NO: 7728 - DNA, 20 bp, Artificial Sequence
  Description of Artificial Sequence: Synthetic oligonucleotide
ggctcacggcagcctttaac

SEQ ID NO: 7729 - DNA, 20 bp, Artificial Sequence
  Description of Artificial Sequence: Synthetic oligonucleotide
gctcacggcagcctttaact

SEQ ID NO: 7730 - DNA, 20 bp, Artificial Sequence
  Description of Artificial Sequence: Synthetic oligonucleotide
ctcacggcagcctttaactc

SEQ ID NO: 7731 - DNA, 20 bp, Artificial Sequence
  Description of Artificial Sequence: Synthetic oligonucleotide
tcacggcagcctttaactcc

SEQ ID NO: 7732 - DNA, 20 bp, Artificial Sequence
  Description of Artificial Sequence: Synthetic oligonucleotide
cacggcagcctttaactcct

SEQ ID NO: 7733 - DNA, 20 bp, Artificial Sequence
  Description of Artificial Sequence: Synthetic oligonucleotide
acggcagcctttaactcctg

SEQ ID NO: 7734 - DNA, 20 bp, Artificial Sequence
  Description of Artificial Sequence: Synthetic oligonucleotide
cggcagcctttaactcctgg

SEQ ID NO: 7735 - DNA, 20 bp, Artificial Sequence
  Description of Artificial Sequence: Synthetic oligonucleotide
ggcagcctttaactcctggg

SEQ ID NO: 7736 - DNA, 20 bp, Artificial Sequence
  Description of Artificial Sequence: Synthetic oligonucleotide
gcagcctttaactcctgggc

SEQ ID NO: 7737 - DNA, 20 bp, Artificial Sequence
  Description of Artificial Sequence: Synthetic oligonucleotide
cagcctttaactcctgggct

SEQ ID NO: 7738 - DNA, 20 bp, Artificial Sequence
  Description of Artificial Sequence: Synthetic oligonucleotide
agcctttaactcctgggctg

SEQ ID NO: 7739 - DNA, 20 bp, Artificial Sequence
  Description of Artificial Sequence: Synthetic oligonucleotide
gcctttaactcctgggctga

SEQ ID NO: 7740 - DNA, 20 bp, Artificial Sequence
  Description of Artificial Sequence: Synthetic oligonucleotide
cctttaactcctgggctgaa

SEQ ID NO: 7741 - DNA, 20 bp, Artificial Sequence
  Description of Artificial Sequence: Synthetic oligonucleotide
ctttaactcctgggctgaag

SEQ ID NO: 7742 - DNA, 20 bp, Artificial Sequence
  Description of Artificial Sequence: Synthetic oligonucleotide
tttaactcctgggctgaagt

SEQ ID NO: 7743 - DNA, 20 bp, Artificial Sequence
  Description of Artificial Sequence: Synthetic oligonucleotide
ttaactcctgggctgaagtg

SEQ ID NO: 7744 - DNA, 20 bp, Artificial Sequence
  Description of Artificial Sequence: Synthetic oligonucleotide
taactcctgggctgaagtga

SEQ ID NO: 7745 - DNA, 20 bp, Artificial Sequence
  Description of Artificial Sequence: Synthetic oligonucleotide
aactcctgggctgaagtgac

SEQ ID NO: 7746 - DNA, 20 bp, Artificial Sequence
  Description of Artificial Sequence: Synthetic oligonucleotide
actcctgggctgaagtgacc

SEQ ID NO: 7747 - DNA, 20 bp, Artificial Sequence
  Description of Artificial Sequence: Synthetic oligonucleotide
ctcctgggctgaagtgaccc

SEQ ID NO: 7748 - DNA, 20 bp, Artificial Sequence
  Description of Artificial Sequence: Synthetic oligonucleotide
tcctgggctgaagtgaccct

SEQ ID NO: 7749 - DNA, 20 bp, Artificial Sequence
  Description of Artificial Sequence: Synthetic oligonucleotide
cctgggctgaagtgaccctc

SEQ ID NO: 7750 - DNA, 20 bp, Artificial Sequence
  Description of Artificial Sequence: Synthetic oligonucleotide
ctgggctgaagtgaccctcc

SEQ ID NO: 7751 - DNA, 20 bp, Artificial Sequence
  Description of Artificial Sequence: Synthetic oligonucleotide
tgggctgaagtgaccctcct

SEQ ID NO: 7752 - DNA, 20 bp, Artificial Sequence
  Description of Artificial Sequence: Synthetic oligonucleotide
gggctgaagtgaccctcctg

SEQ ID NO: 7753 - DNA, 20 bp, Artificial Sequence
  Description of Artificial Sequence: Synthetic oligonucleotide
ggctgaagtgaccctcctgc

SEQ ID NO: 7754 - DNA, 20 bp, Artificial Sequence
  Description of Artificial Sequence: Synthetic oligonucleotide
gctgaagtgaccctcctgcc

SEQ ID NO: 7755 - DNA, 20 bp, Artificial Sequence
  Description of Artificial Sequence: Synthetic oligonucleotide
ctgaagtgaccctcctgcct

SEQ ID NO: 7756 - DNA, 20 bp, Artificial Sequence
  Description of Artificial Sequence: Synthetic oligonucleotide
tgaagtgaccctcctgcctt

SEQ ID NO: 7757 - DNA, 20 bp, Artificial Sequence
  Description of Artificial Sequence: Synthetic oligonucleotide
gaagtgaccctcctgccttg

SEQ ID NO: 7758 - DNA, 20 bp, Artificial Sequence
  Description of Artificial Sequence: Synthetic oligonucleotide
aagtgaccctcctgccttgg

SEQ ID NO: 7759 - DNA, 20 bp, Artificial Sequence
  Description of Artificial Sequence: Synthetic oligonucleotide
agtgaccctcctgccttggc

SEQ ID NO: 7760 - DNA, 20 bp, Artificial Sequence
  Description of Artificial Sequence: Synthetic oligonucleotide
gtgaccctcctgccttggcc

SEQ ID NO: 7761 - DNA, 20 bp, Artificial Sequence
  Description of Artificial Sequence: Synthetic oligonucleotide
tgaccctcctgccttggcct

SEQ ID NO: 7762 - DNA, 20 bp, Artificial Sequence
  Description of Artificial Sequence: Synthetic oligonucleotide
gaccctcctgccttggcctc

SEQ ID NO: 7763 - DNA, 20 bp, Artificial Sequence
  Description of Artificial Sequence: Synthetic oligonucleotide
accctcctgccttggcctcc

SEQ ID NO: 7764 - DNA, 20 bp, Artificial Sequence
  Description of Artificial Sequence: Synthetic oligonucleotide
ccctcctgccttggcctccc

SEQ ID NO: 7765 - DNA, 20 bp, Artificial Sequence
  Description of Artificial Sequence: Synthetic oligonucleotide
cctcctgccttggcctcccg

SEQ ID NO: 7766 - DNA, 20 bp, Artificial Sequence
  Description of Artificial Sequence: Synthetic oligonucleotide
ctcctgccttggcctcccga

SEQ ID NO: 7767 - DNA, 20 bp, Artificial Sequence
  Description of Artificial Sequence: Synthetic oligonucleotide
tcctgccttggcctcccgag

SEQ ID NO: 7768 - DNA, 20 bp, Artificial Sequence
  Description of Artificial Sequence: Synthetic oligonucleotide
cctgccttggcctcccgagt

SEQ ID NO: 7769 - DNA, 20 bp, Artificial Sequence
  Description of Artificial Sequence: Synthetic oligonucleotide
ctgccttggcctcccgagta

SEQ ID NO: 7770 - DNA, 20 bp, Artificial Sequence
  Description of Artificial Sequence: Synthetic oligonucleotide
tgccttggcctcccgagtag

SEQ ID NO: 7771 - DNA, 20 bp, Artificial Sequence
  Description of Artificial Sequence: Synthetic oligonucleotide
gccttggcctcccgagtagc

SEQ ID NO: 7772 - DNA, 20 bp, Artificial Sequence
  Description of Artificial Sequence: Synthetic oligonucleotide
ccttggcctcccgagtagct

SEQ ID NO: 7773 - DNA, 20 bp, Artificial Sequence
  Description of Artificial Sequence: Synthetic oligonucleotide
cttggcctcccgagtagctg

SEQ ID NO: 7774 - DNA, 20 bp, Artificial Sequence
  Description of Artificial Sequence: Synthetic oligonucleotide
ttggcctcccgagtagctgg

SEQ ID NO: 7775 - DNA, 20 bp, Artificial Sequence
  Description of Artificial Sequence: Synthetic oligonucleotide
tggcctcccgagtagctggg

SEQ ID NO: 7776 - DNA, 20 bp, Artificial Sequence
  Description of Artificial Sequence: Synthetic oligonucleotide
ggcctcccgagtagctggga

SEQ ID NO: 7777 - DNA, 20 bp, Artificial Sequence
  Description of Artificial Sequence: Synthetic oligonucleotide
gcctcccgagtagctgggac

SEQ ID NO: 7778 - DNA, 20 bp, Artificial Sequence
  Description of Artificial Sequence: Synthetic oligonucleotide
cctcccgagtagctgggact

SEQ ID NO: 7779 - DNA, 20 bp, Artificial Sequence
  Description of Artificial Sequence: Synthetic oligonucleotide
ctcccgagtagctgggacta

SEQ ID NO: 7780 - DNA, 20 bp, Artificial Sequence
  Description of Artificial Sequence: Synthetic oligonucleotide
tcccgagtagctgggactac

SEQ ID NO: 7781 - DNA, 20 bp, Artificial Sequence
  Description of Artificial Sequence: Synthetic oligonucleotide
cccgagtagctgggactaca

SEQ ID NO: 7782 - DNA, 20 bp, Artificial Sequence
  Description of Artificial Sequence: Synthetic oligonucleotide
ccgagtagctgggactacag

SEQ ID NO: 7783 - DNA, 20 bp, Artificial Sequence
  Description of Artificial Sequence: Synthetic oligonucleotide
cgagtagctgggactacagg

SEQ ID NO: 7784 - DNA, 20 bp, Artificial Sequence
  Description of Artificial Sequence: Synthetic oligonucleotide
gagtagctgggactacaggc

SEQ ID NO: 7785 - DNA, 20 bp, Artificial Sequence
  Description of Artificial Sequence: Synthetic oligonucleotide
agtagctgggactacaggca

SEQ ID NO: 7786 - DNA, 20 bp, Artificial Sequence
  Description of Artificial Sequence: Synthetic oligonucleotide
gtagctgggactacaggcat

SEQ ID NO: 7787 - DNA, 20 bp, Artificial Sequence
  Description of Artificial Sequence: Synthetic oligonucleotide
tagctgggactacaggcatg

SEQ ID NO: 7788 - DNA, 20 bp, Artificial Sequence
  Description of Artificial Sequence: Synthetic oligonucleotide
agctgggactacaggcatgt

SEQ ID NO: 7789 - DNA, 20 bp, Artificial Sequence
  Description of Artificial Sequence: Synthetic oligonucleotide
gctgggactacaggcatgtg

SEQ ID NO: 7790 - DNA, 20 bp, Artificial Sequence
  Description of Artificial Sequence: Synthetic oligonucleotide
ctgggactacaggcatgtgc

SEQ ID NO: 7791 - DNA, 20 bp, Artificial Sequence
  Description of Artificial Sequence: Synthetic oligonucleotide
tgggactacaggcatgtgcc

SEQ ID NO: 7792 - DNA, 20 bp, Artificial Sequence
  Description of Artificial Sequence: Synthetic oligonucleotide
gggactacaggcatgtgcca

SEQ ID NO: 7793 - DNA, 20 bp, Artificial Sequence
  Description of Artificial Sequence: Synthetic oligonucleotide
ggactacaggcatgtgccac

SEQ ID NO: 7794 - DNA, 20 bp, Artificial Sequence
  Description of Artificial Sequence: Synthetic oligonucleotide
gactacaggcatgtgccacc

SEQ ID NO: 7795 - DNA, 20 bp, Artificial Sequence
  Description of Artificial Sequence: Synthetic oligonucleotide
actacaggcatgtgccacca

SEQ ID NO: 7796 - DNA, 20 bp, Artificial Sequence
  Description of Artificial Sequence: Synthetic oligonucleotide
ctacaggcatgtgccaccat

SEQ ID NO: 7797 - DNA, 20 bp, Artificial Sequence
  Description of Artificial Sequence: Synthetic oligonucleotide
tacaggcatgtgccaccatg

SEQ ID NO: 7798 - DNA, 20 bp, Artificial Sequence
  Description of Artificial Sequence: Synthetic oligonucleotide
acaggcatgtgccaccatgc

SEQ ID NO: 7799 - DNA, 20 bp, Artificial Sequence
  Description of Artificial Sequence: Synthetic oligonucleotide
caggcatgtgccaccatgcc

SEQ ID NO: 7800 - DNA, 20 bp, Artificial Sequence
  Description of Artificial Sequence: Synthetic oligonucleotide
aggcatgtgccaccatgccc

SEQ ID NO: 7801 - DNA, 20 bp, Artificial Sequence
  Description of Artificial Sequence: Synthetic oligonucleotide
ggcatgtgccaccatgccca

SEQ ID NO: 7802 - DNA, 20 bp, Artificial Sequence
  Description of Artificial Sequence: Synthetic oligonucleotide
gcatgtgccaccatgcccag

SEQ ID NO: 7803 - DNA, 20 bp, Artificial Sequence
  Description of Artificial Sequence: Synthetic oligonucleotide
catgtgccaccatgcccagc

SEQ ID NO: 7804 - DNA, 20 bp, Artificial Sequence
  Description of Artificial Sequence: Synthetic oligonucleotide
atgtgccaccatgcccagca

SEQ ID NO: 7805 - DNA, 20 bp, Artificial Sequence
  Description of Artificial Sequence: Synthetic oligonucleotide
tgtgccaccatgcccagcaa

SEQ ID NO: 7806 - DNA, 20 bp, Artificial Sequence
  Description of Artificial Sequence: Synthetic oligonucleotide
gtgccaccatgcccagcaag

SEQ ID NO: 7807 - DNA, 20 bp, Artificial Sequence
  Description of Artificial Sequence: Synthetic oligonucleotide
tgccaccatgcccagcaagg

SEQ ID NO: 7808 - DNA, 20 bp, Artificial Sequence
  Description of Artificial Sequence: Synthetic oligonucleotide
gccaccatgcccagcaaggg

SEQ ID NO: 7809 - DNA, 20 bp, Artificial Sequence
  Description of Artificial Sequence: Synthetic oligonucleotide
ccaccatgcccagcaagggc

SEQ ID NO: 7810 - DNA, 20 bp, Artificial Sequence
  Description of Artificial Sequence: Synthetic oligonucleotide
caccatgcccagcaagggct

SEQ ID NO: 7811 - DNA, 20 bp, Artificial Sequence
  Description of Artificial Sequence: Synthetic oligonucleotide
accatgcccagcaagggctg

SEQ ID NO: 7812 - DNA, 20 bp, Artificial Sequence
  Description of Artificial Sequence: Synthetic oligonucleotide
ccatgcccagcaagggctga

SEQ ID NO: 7813 - DNA, 20 bp, Artificial Sequence
  Description of Artificial Sequence: Synthetic oligonucleotide
catgcccagcaagggctgaa

SEQ ID NO: 7814 - DNA, 20 bp, Artificial Sequence
  Description of Artificial Sequence: Synthetic oligonucleotide
atgcccagcaagggctgaat

SEQ ID NO: 7815 - DNA, 20 bp, Artificial Sequence
  Description of Artificial Sequence: Synthetic oligonucleotide
tgcccagcaagggctgaatt

SEQ ID NO: 7816 - DNA, 20 bp, Artificial Sequence
  Description of Artificial Sequence: Synthetic oligonucleotide
gcccagcaagggctgaattt

SEQ ID NO: 7817 - DNA, 20 bp, Artificial Sequence
  Description of Artificial Sequence: Synthetic oligonucleotide
cccagcaagggctgaatttt

SEQ ID NO: 7818 - DNA, 20 bp, Artificial Sequence
  Description of Artificial Sequence: Synthetic oligonucleotide
ccagcaagggctgaatttta

SEQ ID NO: 7819 - DNA, 20 bp, Artificial Sequence
  Description of Artificial Sequence: Synthetic oligonucleotide
cagcaagggctgaattttat

SEQ ID NO: 7820 - DNA, 20 bp, Artificial Sequence
  Description of Artificial Sequence: Synthetic oligonucleotide
agcaagggctgaattttatt

SEQ ID NO: 7821 - DNA, 20 bp, Artificial Sequence
  Description of Artificial Sequence: Synthetic oligonucleotide
gcaagggctgaattttattt

SEQ ID NO: 7822 - DNA, 20 bp, Artificial Sequence
  Description of Artificial Sequence: Synthetic oligonucleotide
caagggctgaattttatttt

SEQ ID NO: 7823 - DNA, 20 bp, Artificial Sequence
  Description of Artificial Sequence: Synthetic oligonucleotide
aagggctgaattttatttta

SEQ ID NO: 7824 - DNA, 20 bp, Artificial Sequence
  Description of Artificial Sequence: Synthetic oligonucleotide
agggctgaattttattttat

SEQ ID NO: 7825 - DNA, 20 bp, Artificial Sequence
  Description of Artificial Sequence: Synthetic oligonucleotide
gggctgaattttattttatt

SEQ ID NO: 7826 - DNA, 20 bp, Artificial Sequence
  Description of Artificial Sequence: Synthetic oligonucleotide
ggctgaattttattttattt

SEQ ID NO: 7827 - DNA, 20 bp, Artificial Sequence
  Description of Artificial Sequence: Synthetic oligonucleotide
gctgaattttattttatttt

SEQ ID NO: 7828 - DNA, 20 bp, Artificial Sequence
  Description of Artificial Sequence: Synthetic oligonucleotide
ctgaattttattttatttta

SEQ ID NO: 7829 - DNA, 20 bp, Artificial Sequence
  Description of Artificial Sequence: Synthetic oligonucleotide
tgaattttattttattttat

SEQ ID NO: 7830 - DNA, 20 bp, Artificial Sequence
  Description of Artificial Sequence: Synthetic oligonucleotide
gaattttattttattttatt

SEQ ID NO: 7831 - DNA, 20 bp, Artificial Sequence
  Description of Artificial Sequence: Synthetic oligonucleotide
aattttattttattttattt

SEQ ID NO: 7832 - DNA, 20 bp, Artificial Sequence
  Description of Artificial Sequence: Synthetic oligonucleotide
attttattttattttatttt

SEQ ID NO: 7833 - DNA, 20 bp, Artificial Sequence
  Description of Artificial Sequence: Synthetic oligonucleotide
ttttattttattttatttta

SEQ ID NO: 7834 - DNA, 20 bp, Artificial Sequence
  Description of Artificial Sequence: Synthetic oligonucleotide
tttattttattttattttat

SEQ ID NO: 7835 - DNA, 20 bp, Artificial Sequence
  Description of Artificial Sequence: Synthetic oligonucleotide
ttattttattttattttatt

SEQ ID NO: 7836 - DNA, 20 bp, Artificial Sequence
  Description of Artificial Sequence: Synthetic oligonucleotide
tattttattttattttattt

SEQ ID NO: 7837 - DNA, 20 bp, Artificial Sequence
  Description of Artificial Sequence: Synthetic oligonucleotide
attttattttattttatttt

SEQ ID NO: 7838 - DNA, 20 bp, Artificial Sequence
  Description of Artificial Sequence: Synthetic oligonucleotide
ttttattttattttattttc

SEQ ID NO: 7839 - DNA, 20 bp, Artificial Sequence
  Description of Artificial Sequence: Synthetic oligonucleotide
tttattttattttattttct

SEQ ID NO: 7840 - DNA, 20 bp, Artificial Sequence
  Description of Artificial Sequence: Synthetic oligonucleotide
ttattttattttattttctc

SEQ ID NO: 7841 - DNA, 20 bp, Artificial Sequence
  Description of Artificial Sequence: Synthetic oligonucleotide
tattttattttattttctct

SEQ ID NO: 7842 - DNA, 20 bp, Artificial Sequence
  Description of Artificial Sequence: Synthetic oligonucleotide
attttattttattttctctt

SEQ ID NO: 7843 - DNA, 20 bp, Artificial Sequence
  Description of Artificial Sequence: Synthetic oligonucleotide
ttttattttattttctcttt

SEQ ID NO: 7844 - DNA, 20 bp, Artificial Sequence
  Description of Artificial Sequence: Synthetic oligonucleotide
tttattttattttctctttt

SEQ ID NO: 7845 - DNA, 20 bp, Artificial Sequence
  Description of Artificial Sequence: Synthetic oligonucleotide
ttattttattttctcttttt

SEQ ID NO: 7846 - DNA, 20 bp, Artificial Sequence
  Description of Artificial Sequence: Synthetic oligonucleotide
tattttattttctctttttt

SEQ ID NO: 7847 - DNA, 20 bp, Artificial Sequence
  Description of Artificial Sequence: Synthetic oligonucleotide
attttattttctctttttta

SEQ ID NO: 7848 - DNA, 20 bp, Artificial Sequence
  Description of Artificial Sequence: Synthetic oligonucleotide
ttttattttctcttttttat

SEQ ID NO: 7849 - DNA, 20 bp, Artificial Sequence
  Description of Artificial Sequence: Synthetic oligonucleotide
tttattttctcttttttatt

SEQ ID NO: 7850 - DNA, 20 bp, Artificial Sequence
  Description of Artificial Sequence: Synthetic oligonucleotide
ttattttctcttttttattt

SEQ ID NO: 7851 - DNA, 20 bp, Artificial Sequence
  Description of Artificial Sequence: Synthetic oligonucleotide
tattttctcttttttatttt

SEQ ID NO: 7852 - DNA, 20 bp, Artificial Sequence
  Description of Artificial Sequence: Synthetic oligonucleotide
attttctcttttttattttt

SEQ ID NO: 7853 - DNA, 20 bp, Artificial Sequence
  Description of Artificial Sequence: Synthetic oligonucleotide
ttttctcttttttatttttt

SEQ ID NO: 7854 - DNA, 20 bp, Artificial Sequence
  Description of Artificial Sequence: Synthetic oligonucleotide
tttctcttttttattttttt

SEQ ID NO: 7855 - DNA, 20 bp, Artificial Sequence
  Description of Artificial Sequence: Synthetic oligonucleotide
ttctcttttttatttttttg

SEQ ID NO: 7856 - DNA, 20 bp, Artificial Sequence
  Description of Artificial Sequence: Synthetic oligonucleotide
tctcttttttatttttttga

SEQ ID NO: 7857 - DNA, 20 bp, Artificial Sequence
  Description of Artificial Sequence: Synthetic oligonucleotide
ctcttttttatttttttgat

SEQ ID NO: 7858 - DNA, 20 bp, Artificial Sequence
  Description of Artificial Sequence: Synthetic oligonucleotide
tcttttttatttttttgatg

SEQ ID NO: 7859 - DNA, 20 bp, Artificial Sequence
  Description of Artificial Sequence: Synthetic oligonucleotide
cttttttatttttttgatgg

SEQ ID NO: 7860 - DNA, 20 bp, Artificial Sequence
  Description of Artificial Sequence: Synthetic oligonucleotide
ttttttatttttttgatggg

SEQ ID NO: 7861 - DNA, 20 bp, Artificial Sequence
  Description of Artificial Sequence: Synthetic oligonucleotide
tttttatttttttgatgggg

SEQ ID NO: 7862 - DNA, 20 bp, Artificial Sequence
  Description of Artificial Sequence: Synthetic oligonucleotide
ttttatttttttgatggggg

SEQ ID NO: 7863 - DNA, 20 bp, Artificial Sequence
  Description of Artificial Sequence: Synthetic oligonucleotide
tttatttttttgatgggggg

SEQ ID NO: 7864 - DNA, 20 bp, Artificial Sequence
  Description of Artificial Sequence: Synthetic oligonucleotide
ttatttttttgatgggggga

SEQ ID NO: 7865 - DNA, 20 bp, Artificial Sequence
  Description of Artificial Sequence: Synthetic oligonucleotide
tatttttttgatggggggac

SEQ ID NO: 7866 - DNA, 20 bp, Artificial Sequence
  Description of Artificial Sequence: Synthetic oligonucleotide
atttttttgatggggggacg

SEQ ID NO: 7867 - DNA, 20 bp, Artificial Sequence
  Description of Artificial Sequence: Synthetic oligonucleotide
tttttttgatggggggacgg

SEQ ID NO: 7868 - DNA, 20 bp, Artificial Sequence
  Description of Artificial Sequence: Synthetic oligonucleotide
ttttttgatggggggacgga

SEQ ID NO: 7869 - DNA, 20 bp, Artificial Sequence
  Description of Artificial Sequence: Synthetic oligonucleotide
tttttgatggggggacggag

SEQ ID NO: 7870 - DNA, 20 bp, Artificial Sequence
  Description of Artificial Sequence: Synthetic oligonucleotide
ttttgatggggggacggagt

SEQ ID NO: 7871 - DNA, 20 bp, Artificial Sequence
  Description of Artificial Sequence: Synthetic oligonucleotide
tttgatggggggacggagtc

SEQ ID NO: 7872 - DNA, 20 bp, Artificial Sequence
  Description of Artificial Sequence: Synthetic oligonucleotide
ttgatggggggacggagtct

SEQ ID NO: 7873 - DNA, 20 bp, Artificial Sequence
  Description of Artificial Sequence: Synthetic oligonucleotide
tgatggggggacggagtctc

SEQ ID NO: 7874 - DNA, 20 bp, Artificial Sequence
  Description of Artificial Sequence: Synthetic oligonucleotide
gatggggggacggagtctcg

SEQ ID NO: 7875 - DNA, 20 bp, Artificial Sequence
  Description of Artificial Sequence: Synthetic oligonucleotide
atggggggacggagtctcgc

SEQ ID NO: 7876 - DNA, 20 bp, Artificial Sequence
  Description of Artificial Sequence: Synthetic oligonucleotide
tggggggacggagtctcgct

SEQ ID NO: 7877 - DNA, 20 bp, Artificial Sequence
  Description of Artificial Sequence: Synthetic oligonucleotide
ggggggacggagtctcgctc

SEQ ID NO: 7878 - DNA, 20 bp, Artificial Sequence
  Description of Artificial Sequence: Synthetic oligonucleotide
gggggacggagtctcgctct

SEQ ID NO: 7879 - DNA, 20 bp, Artificial Sequence
  Description of Artificial Sequence: Synthetic oligonucleotide
ggggacggagtctcgctctg

SEQ ID NO: 7880 - DNA, 20 bp, Artificial Sequence
  Description of Artificial Sequence: Synthetic oligonucleotide
gggacggagtctcgctctgt

SEQ ID NO: 7881 - DNA, 20 bp, Artificial Sequence
  Description of Artificial Sequence: Synthetic oligonucleotide
ggacggagtctcgctctgtc

SEQ ID NO: 7882 - DNA, 20 bp, Artificial Sequence
  Description of Artificial Sequence: Synthetic oligonucleotide
gacggagtctcgctctgtcg

SEQ ID NO: 7883 - DNA, 20 bp, Artificial Sequence
  Description of Artificial Sequence: Synthetic oligonucleotide
acggagtctcgctctgtcgc

SEQ ID NO: 7884 - DNA, 20 bp, Artificial Sequence
  Description of Artificial Sequence: Synthetic oligonucleotide
cggagtctcgctctgtcgcc

SEQ ID NO: 7885 - DNA, 20 bp, Artificial Sequence
  Description of Artificial Sequence: Synthetic oligonucleotide
ggagtctcgctctgtcgccc

SEQ ID NO: 7886 - DNA, 20 bp, Artificial Sequence
  Description of Artificial Sequence: Synthetic oligonucleotide
gagtctcgctctgtcgccca

SEQ ID NO: 7887 - DNA, 20 bp, Artificial Sequence
  Description of Artificial Sequence: Synthetic oligonucleotide
agtctcgctctgtcgcccag

SEQ ID NO: 7888 - DNA, 20 bp, Artificial Sequence
  Description of Artificial Sequence: Synthetic oligonucleotide
gtctcgctctgtcgcccagg

SEQ ID NO: 7889 - DNA, 20 bp, Artificial Sequence
  Description of Artificial Sequence: Synthetic oligonucleotide
tctcgctctgtcgcccaggc

SEQ ID NO: 7890 - DNA, 20 bp, Artificial Sequence
  Description of Artificial Sequence: Synthetic oligonucleotide
ctcgctctgtcgcccaggct

SEQ ID NO: 7891 - DNA, 20 bp, Artificial Sequence
  Description of Artificial Sequence: Synthetic oligonucleotide
tcgctctgtcgcccaggctg

SEQ ID NO: 7892 - DNA, 20 bp, Artificial Sequence
  Description of Artificial Sequence: Synthetic oligonucleotide
cgctctgtcgcccaggctgg

SEQ ID NO: 7893 - DNA, 20 bp, Artificial Sequence
  Description of Artificial Sequence: Synthetic oligonucleotide
gctctgtcgcccaggctgga

SEQ ID NO: 7894 - DNA, 20 bp, Artificial Sequence
  Description of Artificial Sequence: Synthetic oligonucleotide
ctctgtcgcccaggctggag

SEQ ID NO: 7895 - DNA, 20 bp, Artificial Sequence
  Description of Artificial Sequence: Synthetic oligonucleotide
tctgtcgcccaggctggagt

SEQ ID NO: 7896 - DNA, 20 bp, Artificial Sequence
  Description of Artificial Sequence: Synthetic oligonucleotide
ctgtcgcccaggctggagtg

SEQ ID NO: 7897 - DNA, 20 bp, Artificial Sequence
  Description of Artificial Sequence: Synthetic oligonucleotide
tgtcgcccaggctggagtgc

SEQ ID NO: 7898 - DNA, 20 bp, Artificial Sequence
  Description of Artificial Sequence: Synthetic oligonucleotide
gtcgcccaggctggagtgcg

SEQ ID NO: 7899 - DNA, 20 bp, Artificial Sequence
  Description of Artificial Sequence: Synthetic oligonucleotide
tcgcccaggctggagtgcgg

SEQ ID NO: 7900 - DNA, 20 bp, Artificial Sequence
  Description of Artificial Sequence: Synthetic oligonucleotide
cgcccaggctggagtgcggt

SEQ ID NO: 7901 - DNA, 20 bp, Artificial Sequence
  Description of Artificial Sequence: Synthetic oligonucleotide
gcccaggctggagtgcggtg

SEQ ID NO: 7902 - DNA, 20 bp, Artificial Sequence
  Description of Artificial Sequence: Synthetic oligonucleotide
cccaggctggagtgcggtgg

SEQ ID NO: 7903 - DNA, 20 bp, Artificial Sequence
  Description of Artificial Sequence: Synthetic oligonucleotide
ccaggctggagtgcggtggc

SEQ ID NO: 7904 - DNA, 20 bp, Artificial Sequence
  Description of Artificial Sequence: Synthetic oligonucleotide
caggctggagtgcggtggcg

SEQ ID NO: 7905 - DNA, 20 bp, Artificial Sequence
  Description of Artificial Sequence: Synthetic oligonucleotide
aggctggagtgcggtggcgt

SEQ ID NO: 7906 - DNA, 20 bp, Artificial Sequence
  Description of Artificial Sequence: Synthetic oligonucleotide
ggctggagtgcggtggcgtc

SEQ ID NO: 7907 - DNA, 20 bp, Artificial Sequence
  Description of Artificial Sequence: Synthetic oligonucleotide
gctggagtgcggtggcgtca

SEQ ID NO: 7908 - DNA, 20 bp, Artificial Sequence
  Description of Artificial Sequence: Synthetic oligonucleotide
ctggagtgcggtggcgtcat

SEQ ID NO: 7909 - DNA, 20 bp, Artificial Sequence
  Description of Artificial Sequence: Synthetic oligonucleotide
tggagtgcggtggcgtcatc

SEQ ID NO: 7910 - DNA, 20 bp, Artificial Sequence
  Description of Artificial Sequence: Synthetic oligonucleotide
ggagtgcggtggcgtcatct

SEQ ID NO: 7911 - DNA, 20 bp, Artificial Sequence
  Description of Artificial Sequence: Synthetic oligonucleotide
gagtgcggtggcgtcatctc

SEQ ID NO: 7912 - DNA, 20 bp, Artificial Sequence
  Description of Artificial Sequence: Synthetic oligonucleotide
agtgcggtggcgtcatctca

SEQ ID NO: 7913 - DNA, 20 bp, Artificial Sequence
  Description of Artificial Sequence: Synthetic oligonucleotide
gtgcggtggcgtcatctcag

SEQ ID NO: 7914 - DNA, 20 bp, Artificial Sequence
  Description of Artificial Sequence: Synthetic oligonucleotide
tgcggtggcgtcatctcagc

SEQ ID NO: 7915 - DNA, 20 bp, Artificial Sequence
  Description of Artificial Sequence: Synthetic oligonucleotide
gcggtggcgtcatctcagct

SEQ ID NO: 7916 - DNA, 20 bp, Artificial Sequence
  Description of Artificial Sequence: Synthetic oligonucleotide
cggtggcgtcatctcagctc

SEQ ID NO: 7917 - DNA, 20 bp, Artificial Sequence
  Description of Artificial Sequence: Synthetic oligonucleotide
ggtggcgtcatctcagctca

SEQ ID NO: 7918 - DNA, 20 bp, Artificial Sequence
  Description of Artificial Sequence: Synthetic oligonucleotide
gtggcgtcatctcagctcac

SEQ ID NO: 7919 - DNA, 20 bp, Artificial Sequence
  Description of Artificial Sequence: Synthetic oligonucleotide
tggcgtcatctcagctcact

SEQ ID NO: 7920 - DNA, 20 bp, Artificial Sequence
  Description of Artificial Sequence: Synthetic oligonucleotide
ggcgtcatctcagctcactg

SEQ ID NO: 7921 - DNA, 20 bp, Artificial Sequence
  Description of Artificial Sequence: Synthetic oligonucleotide
gcgtcatctcagctcactgc

SEQ ID NO: 7922 - DNA, 20 bp, Artificial Sequence
  Description of Artificial Sequence: Synthetic oligonucleotide
cgtcatctcagctcactgca

SEQ ID NO: 7923 - DNA, 20 bp, Artificial Sequence
  Description of Artificial Sequence: Synthetic oligonucleotide
gtcatctcagctcactgcaa

SEQ ID NO: 7924 - DNA, 20 bp, Artificial Sequence
  Description of Artificial Sequence: Synthetic oligonucleotide
tcatctcagctcactgcaac

SEQ ID NO: 7925 - DNA, 20 bp, Artificial Sequence
  Description of Artificial Sequence: Synthetic oligonucleotide
catctcagctcactgcaacc

SEQ ID NO: 7926 - DNA, 20 bp, Artificial Sequence
  Description of Artificial Sequence: Synthetic oligonucleotide
atctcagctcactgcaacct

SEQ ID NO: 7927 - DNA, 20 bp, Artificial Sequence
  Description of Artificial Sequence: Synthetic oligonucleotide
tctcagctcactgcaacctc

SEQ ID NO: 7928 - DNA, 20 bp, Artificial Sequence
  Description of Artificial Sequence: Synthetic oligonucleotide
ctcagctcactgcaacctct

SEQ ID NO: 7929 - DNA, 20 bp, Artificial Sequence
  Description of Artificial Sequence: Synthetic oligonucleotide
tcagctcactgcaacctctg

SEQ ID NO: 7930 - DNA, 20 bp, Artificial Sequence
  Description of Artificial Sequence: Synthetic oligonucleotide
cagctcactgcaacctctgc

SEQ ID NO: 7931 - DNA, 20 bp, Artificial Sequence
  Description of Artificial Sequence: Synthetic oligonucleotide
agctcactgcaacctctgcc

SEQ ID NO: 7932 - DNA, 20 bp, Artificial Sequence
  Description of Artificial Sequence: Synthetic oligonucleotide
gctcactgcaacctctgcct

SEQ ID NO: 7933 - DNA, 20 bp, Artificial Sequence
  Description of Artificial Sequence: Synthetic oligonucleotide
ctcactgcaacctctgcctc

SEQ ID NO: 7934 - DNA, 20 bp, Artificial Sequence
  Description of Artificial Sequence: Synthetic oligonucleotide
tcactgcaacctctgcctcc

SEQ ID NO: 7935 - DNA, 20 bp, Artificial Sequence
  Description of Artificial Sequence: Synthetic oligonucleotide
cactgcaacctctgcctccc

SEQ ID NO: 7936 - DNA, 20 bp, Artificial Sequence
  Description of Artificial Sequence: Synthetic oligonucleotide
actgcaacctctgcctccca

SEQ ID NO: 7937 - DNA, 20 bp, Artificial Sequence
  Description of Artificial Sequence: Synthetic oligonucleotide
ctgcaacctctgcctcccag

SEQ ID NO: 7938 - DNA, 20 bp, Artificial Sequence
  Description of Artificial Sequence: Synthetic oligonucleotide
tgcaacctctgcctcccagg

SEQ ID NO: 7939 - DNA, 20 bp, Artificial Sequence
  Description of Artificial Sequence: Synthetic oligonucleotide
gcaacctctgcctcccaggt

SEQ ID NO: 7940 - DNA, 20 bp, Artificial Sequence
  Description of Artificial Sequence: Synthetic oligonucleotide
caacctctgcctcccaggtt

SEQ ID NO: 7941 - DNA, 20 bp, Artificial Sequence
  Description of Artificial Sequence: Synthetic oligonucleotide
aacctctgcctcccaggttc

SEQ ID NO: 7942 - DNA, 20 bp, Artificial Sequence
  Description of Artificial Sequence: Synthetic oligonucleotide
acctctgcctcccaggttca

SEQ ID NO: 7943 - DNA, 20 bp, Artificial Sequence
  Description of Artificial Sequence: Synthetic oligonucleotide
cctctgcctcccaggttcaa

SEQ ID NO: 7944 - DNA, 20 bp, Artificial Sequence
  Description of Artificial Sequence: Synthetic oligonucleotide
ctctgcctcccaggttcaag

SEQ ID NO: 7945 - DNA, 20 bp, Artificial Sequence
  Description of Artificial Sequence: Synthetic oligonucleotide
tctgcctcccaggttcaaga

SEQ ID NO: 7946 - DNA, 20 bp, Artificial Sequence
  Description of Artificial Sequence: Synthetic oligonucleotide
ctgcctcccaggttcaagag

SEQ ID NO: 7947 - DNA, 20 bp, Artificial Sequence
  Description of Artificial Sequence: Synthetic oligonucleotide
tgcctcccaggttcaagaga

SEQ ID NO: 7948 - DNA, 20 bp, Artificial Sequence
  Description of Artificial Sequence: Synthetic oligonucleotide
gcctcccaggttcaagagat

SEQ ID NO: 7949 - DNA, 20 bp, Artificial Sequence
  Description of Artificial Sequence: Synthetic oligonucleotide
cctcccaggttcaagagatt

SEQ ID NO: 7950 - DNA, 20 bp, Artificial Sequence
  Description of Artificial Sequence: Synthetic oligonucleotide
ctcccaggttcaagagattc

SEQ ID NO: 7951 - DNA, 20 bp, Artificial Sequence
  Description of Artificial Sequence: Synthetic oligonucleotide
tcccaggttcaagagattct

SEQ ID NO: 7952 - DNA, 20 bp, Artificial Sequence
  Description of Artificial Sequence: Synthetic oligonucleotide
cccaggttcaagagattctc

SEQ ID NO: 7953 - DNA, 20 bp, Artificial Sequence
  Description of Artificial Sequence: Synthetic oligonucleotide
ccaggttcaagagattctcc

SEQ ID NO: 7954 - DNA, 20 bp, Artificial Sequence
  Description of Artificial Sequence: Synthetic oligonucleotide
caggttcaagagattctcct

SEQ ID NO: 7955 - DNA, 20 bp, Artificial Sequence
  Description of Artificial Sequence: Synthetic oligonucleotide
aggttcaagagattctcctg

SEQ ID NO: 7956 - DNA, 20 bp, Artificial Sequence
  Description of Artificial Sequence: Synthetic oligonucleotide
ggttcaagagattctcctgc

SEQ ID NO: 7957 - DNA, 20 bp, Artificial Sequence
  Description of Artificial Sequence: Synthetic oligonucleotide
gttcaagagattctcctgcc

SEQ ID NO: 7958 - DNA, 20 bp, Artificial Sequence
  Description of Artificial Sequence: Synthetic oligonucleotide
ttcaagagattctcctgcct

SEQ ID NO: 7959 - DNA, 20 bp, Artificial Sequence
  Description of Artificial Sequence: Synthetic oligonucleotide
tcaagagattctcctgcctc

SEQ ID NO: 7960 - DNA, 20 bp, Artificial Sequence
  Description of Artificial Sequence: Synthetic oligonucleotide
caagagattctcctgcctca

SEQ ID NO: 7961 - DNA, 20 bp, Artificial Sequence
  Description of Artificial Sequence: Synthetic oligonucleotide
aagagattctcctgcctcag

SEQ ID NO: 7962 - DNA, 20 bp, Artificial Sequence
  Description of Artificial Sequence: Synthetic oligonucleotide
agagattctcctgcctcagc

SEQ ID NO: 7963 - DNA, 20 bp, Artificial Sequence
  Description of Artificial Sequence: Synthetic oligonucleotide
gagattctcctgcctcagcc

SEQ ID NO: 7964 - DNA, 20 bp, Artificial Sequence
  Description of Artificial Sequence: Synthetic oligonucleotide
agattctcctgcctcagcca

SEQ ID NO: 7965 - DNA, 20 bp, Artificial Sequence
  Description of Artificial Sequence: Synthetic oligonucleotide
gattctcctgcctcagccac

SEQ ID NO: 7966 - DNA, 20 bp, Artificial Sequence
  Description of Artificial Sequence: Synthetic oligonucleotide
attctcctgcctcagccacc

SEQ ID NO: 7967 - DNA, 20 bp, Artificial Sequence
  Description of Artificial Sequence: Synthetic oligonucleotide
ttctcctgcctcagccacct

SEQ ID NO: 7968 - DNA, 20 bp, Artificial Sequence
  Description of Artificial Sequence: Synthetic oligonucleotide
tctcctgcctcagccacctg

SEQ ID NO: 7969 - DNA, 20 bp, Artificial Sequence
  Description of Artificial Sequence: Synthetic oligonucleotide
ctcctgcctcagccacctga

SEQ ID NO: 7970 - DNA, 20 bp, Artificial Sequence
  Description of Artificial Sequence: Synthetic oligonucleotide
tcctgcctcagccacctgag

SEQ ID NO: 7971 - DNA, 20 bp, Artificial Sequence
  Description of Artificial Sequence: Synthetic oligonucleotide
cctgcctcagccacctgagt

SEQ ID NO: 7972 - DNA, 20 bp, Artificial Sequence
  Description of Artificial Sequence: Synthetic oligonucleotide
ctgcctcagccacctgagta

SEQ ID NO: 7973 - DNA, 20 bp, Artificial Sequence
  Description of Artificial Sequence: Synthetic oligonucleotide
tgcctcagccacctgagtag

SEQ ID NO: 7974 - DNA, 20 bp, Artificial Sequence
  Description of Artificial Sequence: Synthetic oligonucleotide
gcctcagccacctgagtagc

SEQ ID NO: 7975 - DNA, 20 bp, Artificial Sequence
  Description of Artificial Sequence: Synthetic oligonucleotide
cctcagccacctgagtagct

SEQ ID NO: 7976 - DNA, 20 bp, Artificial Sequence
  Description of Artificial Sequence: Synthetic oligonucleotide
ctcagccacctgagtagctg

SEQ ID NO: 7977 - DNA, 20 bp, Artificial Sequence
  Description of Artificial Sequence: Synthetic oligonucleotide
tcagccacctgagtagctgg

SEQ ID NO: 7978 - DNA, 20 bp, Artificial Sequence
  Description of Artificial Sequence: Synthetic oligonucleotide
cagccacctgagtagctggg

SEQ ID NO: 7979 - DNA, 20 bp, Artificial Sequence
  Description of Artificial Sequence: Synthetic oligonucleotide
agccacctgagtagctggga

SEQ ID NO: 7980 - DNA, 20 bp, Artificial Sequence
  Description of Artificial Sequence: Synthetic oligonucleotide
gccacctgagtagctgggat

SEQ ID NO: 7981 - DNA, 20 bp, Artificial Sequence
  Description of Artificial Sequence: Synthetic oligonucleotide
ccacctgagtagctgggatt

SEQ ID NO: 7982 - DNA, 20 bp, Artificial Sequence
  Description of Artificial Sequence: Synthetic oligonucleotide
cacctgagtagctgggatta

SEQ ID NO: 7983 - DNA, 20 bp, Artificial Sequence
  Description of Artificial Sequence: Synthetic oligonucleotide
acctgagtagctgggattac

SEQ ID NO: 7984 - DNA, 20 bp, Artificial Sequence
  Description of Artificial Sequence: Synthetic oligonucleotide
cctgagtagctgggattaca

SEQ ID NO: 7985 - DNA, 20 bp, Artificial Sequence
  Description of Artificial Sequence: Synthetic oligonucleotide
ctgagtagctgggattacag

SEQ ID NO: 7986 - DNA, 20 bp, Artificial Sequence
  Description of Artificial Sequence: Synthetic oligonucleotide
tgagtagctgggattacagg

SEQ ID NO: 7987 - DNA, 20 bp, Artificial Sequence
  Description of Artificial Sequence: Synthetic oligonucleotide
gagtagctgggattacaggt

SEQ ID NO: 7988 - DNA, 20 bp, Artificial Sequence
  Description of Artificial Sequence: Synthetic oligonucleotide
agtagctgggattacaggtg

SEQ ID NO: 7989 - DNA, 20 bp, Artificial Sequence
  Description of Artificial Sequence: Synthetic oligonucleotide
gtagctgggattacaggtgc

SEQ ID NO: 7990 - DNA, 20 bp, Artificial Sequence
  Description of Artificial Sequence: Synthetic oligonucleotide
tagctgggattacaggtgca

SEQ ID NO: 7991 - DNA, 20 bp, Artificial Sequence
  Description of Artificial Sequence: Synthetic oligonucleotide
agctgggattacaggtgcac

SEQ ID NO: 7992 - DNA, 20 bp, Artificial Sequence
  Description of Artificial Sequence: Synthetic oligonucleotide
gctgggattacaggtgcaca

SEQ ID NO: 7993 - DNA, 20 bp, Artificial Sequence
  Description of Artificial Sequence: Synthetic oligonucleotide
ctgggattacaggtgcacac

SEQ ID NO: 7994 - DNA, 20 bp, Artificial Sequence
  Description of Artificial Sequence: Synthetic oligonucleotide
tgggattacaggtgcacacc

SEQ ID NO: 7995 - DNA, 20 bp, Artificial Sequence
  Description of Artificial Sequence: Synthetic oligonucleotide
gggattacaggtgcacacca

SEQ ID NO: 7996 - DNA, 20 bp, Artificial Sequence
  Description of Artificial Sequence: Synthetic oligonucleotide
ggattacaggtgcacaccac

SEQ ID NO: 7997 - DNA, 20 bp, Artificial Sequence
  Description of Artificial Sequence: Synthetic oligonucleotide
gattacaggtgcacaccacc

SEQ ID NO: 7998 - DNA, 20 bp, Artificial Sequence
  Description of Artificial Sequence: Synthetic oligonucleotide
attacaggtgcacaccacca

SEQ ID NO: 7999 - DNA, 20 bp, Artificial Sequence
  Description of Artificial Sequence: Synthetic oligonucleotide
ttacaggtgcacaccaccat

SEQ ID NO: 8000 - DNA, 20 bp, Artificial Sequence
  Description of Artificial Sequence: Synthetic oligonucleotide
tacaggtgcacaccaccatg

SEQ ID NO: 8001 - DNA, 20 bp, Artificial Sequence
  Description of Artificial Sequence: Synthetic oligonucleotide
acaggtgcacaccaccatgc

SEQ ID NO: 8002 - DNA, 20 bp, Artificial Sequence
  Description of Artificial Sequence: Synthetic oligonucleotide
caggtgcacaccaccatgcc

SEQ ID NO: 8003 - DNA, 20 bp, Artificial Sequence
  Description of Artificial Sequence: Synthetic oligonucleotide
aggtgcacaccaccatgccc

SEQ ID NO: 8004 - DNA, 20 bp, Artificial Sequence
  Description of Artificial Sequence: Synthetic oligonucleotide
ggtgcacaccaccatgcccg

SEQ ID NO: 8005 - DNA, 20 bp, Artificial Sequence
  Description of Artificial Sequence: Synthetic oligonucleotide
gtgcacaccaccatgcccgg

SEQ ID NO: 8006 - DNA, 20 bp, Artificial Sequence
  Description of Artificial Sequence: Synthetic oligonucleotide
tgcacaccaccatgcccggc

SEQ ID NO: 8007 - DNA, 20 bp, Artificial Sequence
  Description of Artificial Sequence: Synthetic oligonucleotide
gcacaccaccatgcccggct

SEQ ID NO: 8008 - DNA, 20 bp, Artificial Sequence
  Description of Artificial Sequence: Synthetic oligonucleotide
cacaccaccatgcccggcta

SEQ ID NO: 8009 - DNA, 20 bp, Artificial Sequence
  Description of Artificial Sequence: Synthetic oligonucleotide
acaccaccatgcccggctaa

SEQ ID NO: 8010 - DNA, 20 bp, Artificial Sequence
  Description of Artificial Sequence: Synthetic oligonucleotide
caccaccatgcccggctaat

SEQ ID NO: 8011 - DNA, 20 bp, Artificial Sequence
  Description of Artificial Sequence: Synthetic oligonucleotide
accaccatgcccggctaatt

SEQ ID NO: 8012 - DNA, 20 bp, Artificial Sequence
  Description of Artificial Sequence: Synthetic oligonucleotide
ccaccatgcccggctaattt

SEQ ID NO: 8013 - DNA, 20 bp, Artificial Sequence
  Description of Artificial Sequence: Synthetic oligonucleotide
caccatgcccggctaatttt

SEQ ID NO: 8014 - DNA, 20 bp, Artificial Sequence
  Description of Artificial Sequence: Synthetic oligonucleotide
accatgcccggctaattttt

SEQ ID NO: 8015 - DNA, 20 bp, Artificial Sequence
  Description of Artificial Sequence: Synthetic oligonucleotide
ccatgcccggctaatttttg

SEQ ID NO: 8016 - DNA, 20 bp, Artificial Sequence
  Description of Artificial Sequence: Synthetic oligonucleotide
catgcccggctaatttttgt

SEQ ID NO: 8017 - DNA, 20 bp, Artificial Sequence
  Description of Artificial Sequence: Synthetic oligonucleotide
atgcccggctaatttttgta

SEQ ID NO: 8018 - DNA, 20 bp, Artificial Sequence
  Description of Artificial Sequence: Synthetic oligonucleotide
tgcccggctaatttttgtat

SEQ ID NO: 8019 - DNA, 20 bp, Artificial Sequence
  Description of Artificial Sequence: Synthetic oligonucleotide
gcccggctaatttttgtatt

SEQ ID NO: 8020 - DNA, 20 bp, Artificial Sequence
  Description of Artificial Sequence: Synthetic oligonucleotide
cccggctaatttttgtattt

SEQ ID NO: 8021 - DNA, 20 bp, Artificial Sequence
  Description of Artificial Sequence: Synthetic oligonucleotide
ccggctaatttttgtatttt

SEQ ID NO: 8022 - DNA, 20 bp, Artificial Sequence
  Description of Artificial Sequence: Synthetic oligonucleotide
cggctaatttttgtattttt

SEQ ID NO: 8023 - DNA, 20 bp, Artificial Sequence
  Description of Artificial Sequence: Synthetic oligonucleotide
ggctaatttttgtattttta

SEQ ID NO: 8024 - DNA, 20 bp, Artificial Sequence
  Description of Artificial Sequence: Synthetic oligonucleotide
gctaatttttgtatttttag

SEQ ID NO: 8025 - DNA, 20 bp, Artificial Sequence
  Description of Artificial Sequence: Synthetic oligonucleotide
ctaatttttgtatttttagt

SEQ ID NO: 8026 - DNA, 20 bp, Artificial Sequence
  Description of Artificial Sequence: Synthetic oligonucleotide
taatttttgtatttttagta

SEQ ID NO: 8027 - DNA, 20 bp, Artificial Sequence
  Description of Artificial Sequence: Synthetic oligonucleotide
aatttttgtatttttagtag

SEQ ID NO: 8028 - DNA, 20 bp, Artificial Sequence
  Description of Artificial Sequence: Synthetic oligonucleotide
atttttgtatttttagtaga

SEQ ID NO: 8029 - DNA, 20 bp, Artificial Sequence
  Description of Artificial Sequence: Synthetic oligonucleotide
tttttgtatttttagtagag

SEQ ID NO: 8030 - DNA, 20 bp, Artificial Sequence
  Description of Artificial Sequence: Synthetic oligonucleotide
ttttgtatttttagtagaga

SEQ ID NO: 8031 - DNA, 20 bp, Artificial Sequence
  Description of Artificial Sequence: Synthetic oligonucleotide
tttgtatttttagtagagac

SEQ ID NO: 8032 - DNA, 20 bp, Artificial Sequence
  Description of Artificial Sequence: Synthetic oligonucleotide
ttgtatttttagtagagacg

SEQ ID NO: 8033 - DNA, 20 bp, Artificial Sequence
  Description of Artificial Sequence: Synthetic oligonucleotide
tgtatttttagtagagacgg

SEQ ID NO: 8034 - DNA, 20 bp, Artificial Sequence
  Description of Artificial Sequence: Synthetic oligonucleotide
gtatttttagtagagacggg

SEQ ID NO: 8035 - DNA, 20 bp, Artificial Sequence
  Description of Artificial Sequence: Synthetic oligonucleotide
tatttttagtagagacgggg

SEQ ID NO: 8036 - DNA, 20 bp, Artificial Sequence
  Description of Artificial Sequence: Synthetic oligonucleotide
atttttagtagagacggggt

SEQ ID NO: 8037 - DNA, 20 bp, Artificial Sequence
  Description of Artificial Sequence: Synthetic oligonucleotide
tttttagtagagacggggtt

SEQ ID NO: 8038 - DNA, 20 bp, Artificial Sequence
  Description of Artificial Sequence: Synthetic oligonucleotide
ttttagtagagacggggttt

SEQ ID NO: 8039 - DNA, 20 bp, Artificial Sequence
  Description of Artificial Sequence: Synthetic oligonucleotide
tttagtagagacggggtttc

SEQ ID NO: 8040 - DNA, 20 bp, Artificial Sequence
  Description of Artificial Sequence: Synthetic oligonucleotide
ttagtagagacggggtttca

SEQ ID NO: 8041 - DNA, 20 bp, Artificial Sequence
  Description of Artificial Sequence: Synthetic oligonucleotide
tagtagagacggggtttcac

SEQ ID NO: 8042 - DNA, 20 bp, Artificial Sequence
  Description of Artificial Sequence: Synthetic oligonucleotide
agtagagacggggtttcacc

SEQ ID NO: 8043 - DNA, 20 bp, Artificial Sequence
  Description of Artificial Sequence: Synthetic oligonucleotide
gtagagacggggtttcacca

SEQ ID NO: 8044 - DNA, 20 bp, Artificial Sequence
  Description of Artificial Sequence: Synthetic oligonucleotide
tagagacggggtttcaccat

SEQ ID NO: 8045 - DNA, 20 bp, Artificial Sequence
  Description of Artificial Sequence: Synthetic oligonucleotide
agagacggggtttcaccatg

SEQ ID NO: 8046 - DNA, 20 bp, Artificial Sequence
  Description of Artificial Sequence: Synthetic oligonucleotide
gagacggggtttcaccatgt

SEQ ID NO: 8047 - DNA, 20 bp, Artificial Sequence
  Description of Artificial Sequence: Synthetic oligonucleotide
agacggggtttcaccatgtt

SEQ ID NO: 8048 - DNA, 20 bp, Artificial Sequence
  Description of Artificial Sequence: Synthetic oligonucleotide
gacggggtttcaccatgttg

SEQ ID NO: 8049 - DNA, 20 bp, Artificial Sequence
  Description of Artificial Sequence: Synthetic oligonucleotide
acggggtttcaccatgttgg

SEQ ID NO: 8050 - DNA, 20 bp, Artificial Sequence
  Description of Artificial Sequence: Synthetic oligonucleotide
cggggtttcaccatgttggt

SEQ ID NO: 8051 - DNA, 20 bp, Artificial Sequence
  Description of Artificial Sequence: Synthetic oligonucleotide
ggggtttcaccatgttggtc

SEQ ID NO: 8052 - DNA, 20 bp, Artificial Sequence
  Description of Artificial Sequence: Synthetic oligonucleotide
gggtttcaccatgttggtca

SEQ ID NO: 8053 - DNA, 20 bp, Artificial Sequence
  Description of Artificial Sequence: Synthetic oligonucleotide
ggtttcaccatgttggtcag

SEQ ID NO: 8054 - DNA, 20 bp, Artificial Sequence
  Description of Artificial Sequence: Synthetic oligonucleotide
gtttcaccatgttggtcagg

SEQ ID NO: 8055 - DNA, 20 bp, Artificial Sequence
  Description of Artificial Sequence: Synthetic oligonucleotide
tttcaccatgttggtcaggc

SEQ ID NO: 8056 - DNA, 20 bp, Artificial Sequence
  Description of Artificial Sequence: Synthetic oligonucleotide
ttcaccatgttggtcaggct

SEQ ID NO: 8057 - DNA, 20 bp, Artificial Sequence
  Description of Artificial Sequence: Synthetic oligonucleotide
tcaccatgttggtcaggctg

SEQ ID NO: 8058 - DNA, 20 bp, Artificial Sequence
  Description of Artificial Sequence: Synthetic oligonucleotide
caccatgttggtcaggctgg

SEQ ID NO: 8059 - DNA, 20 bp, Artificial Sequence
  Description of Artificial Sequence: Synthetic oligonucleotide
accatgttggtcaggctggt

SEQ ID NO: 8060 - DNA, 20 bp, Artificial Sequence
  Description of Artificial Sequence: Synthetic oligonucleotide
ccatgttggtcaggctggtc

SEQ ID NO: 8061 - DNA, 20 bp, Artificial Sequence
  Description of Artificial Sequence: Synthetic oligonucleotide
catgttggtcaggctggtct

SEQ ID NO: 8062 - DNA, 20 bp, Artificial Sequence
  Description of Artificial Sequence: Synthetic oligonucleotide
atgttggtcaggctggtctc

SEQ ID NO: 8063 - DNA, 20 bp, Artificial Sequence
  Description of Artificial Sequence: Synthetic oligonucleotide
tgttggtcaggctggtctcg

SEQ ID NO: 8064 - DNA, 20 bp, Artificial Sequence
  Description of Artificial Sequence: Synthetic oligonucleotide
gttggtcaggctggtctcga

SEQ ID NO: 8065 - DNA, 20 bp, Artificial Sequence
  Description of Artificial Sequence: Synthetic oligonucleotide
ttggtcaggctggtctcgaa

SEQ ID NO: 8066 - DNA, 20 bp, Artificial Sequence
  Description of Artificial Sequence: Synthetic oligonucleotide
tggtcaggctggtctcgaac

SEQ ID NO: 8067 - DNA, 20 bp, Artificial Sequence
  Description of Artificial Sequence: Synthetic oligonucleotide
ggtcaggctggtctcgaact

SEQ ID NO: 8068 - DNA, 20 bp, Artificial Sequence
  Description of Artificial Sequence: Synthetic oligonucleotide
gtcaggctggtctcgaactc

SEQ ID NO: 8069 - DNA, 20 bp, Artificial Sequence
  Description of Artificial Sequence: Synthetic oligonucleotide
tcaggctggtctcgaactcc

SEQ ID NO: 8070 - DNA, 20 bp, Artificial Sequence
  Description of Artificial Sequence: Synthetic oligonucleotide
caggctggtctcgaactcct

SEQ ID NO: 8071 - DNA, 20 bp, Artificial Sequence
  Description of Artificial Sequence: Synthetic oligonucleotide
aggctggtctcgaactcctg

SEQ ID NO: 8072 - DNA, 20 bp, Artificial Sequence
  Description of Artificial Sequence: Synthetic oligonucleotide
ggctggtctcgaactcctga

SEQ ID NO: 8073 - DNA, 20 bp, Artificial Sequence
  Description of Artificial Sequence: Synthetic oligonucleotide
gctggtctcgaactcctgac

SEQ ID NO: 8074 - DNA, 20 bp, Artificial Sequence
  Description of Artificial Sequence: Synthetic oligonucleotide
ctggtctcgaactcctgacc

SEQ ID NO: 8075 - DNA, 20 bp, Artificial Sequence
  Description of Artificial Sequence: Synthetic oligonucleotide
tggtctcgaactcctgacct

SEQ ID NO: 8076 - DNA, 20 bp, Artificial Sequence
  Description of Artificial Sequence: Synthetic oligonucleotide
ggtctcgaactcctgacctc

SEQ ID NO: 8077 - DNA, 20 bp, Artificial Sequence
  Description of Artificial Sequence: Synthetic oligonucleotide
gtctcgaactcctgacctcg

SEQ ID NO: 8078 - DNA, 20 bp, Artificial Sequence
  Description of Artificial Sequence: Synthetic oligonucleotide
tctcgaactcctgacctcgt

SEQ ID NO: 8079 - DNA, 20 bp, Artificial Sequence
  Description of Artificial Sequence: Synthetic oligonucleotide
ctcgaactcctgacctcgtg

SEQ ID NO: 8080 - DNA, 20 bp, Artificial Sequence
  Description of Artificial Sequence: Synthetic oligonucleotide
tcgaactcctgacctcgtga

SEQ ID NO: 8081 - DNA, 20 bp, Artificial Sequence
  Description of Artificial Sequence: Synthetic oligonucleotide
cgaactcctgacctcgtgat

SEQ ID NO: 8082 - DNA, 20 bp, Artificial Sequence
  Description of Artificial Sequence: Synthetic oligonucleotide
gaactcctgacctcgtgatc

SEQ ID NO: 8083 - DNA, 20 bp, Artificial Sequence
  Description of Artificial Sequence: Synthetic oligonucleotide
aactcctgacctcgtgatct

SEQ ID NO: 8084 - DNA, 20 bp, Artificial Sequence
  Description of Artificial Sequence: Synthetic oligonucleotide
actcctgacctcgtgatctg

SEQ ID NO: 8085 - DNA, 20 bp, Artificial Sequence
  Description of Artificial Sequence: Synthetic oligonucleotide
ctcctgacctcgtgatctgt

SEQ ID NO: 8086 - DNA, 20 bp, Artificial Sequence
  Description of Artificial Sequence: Synthetic oligonucleotide
tcctgacctcgtgatctgtc

SEQ ID NO: 8087 - DNA, 20 bp, Artificial Sequence
  Description of Artificial Sequence: Synthetic oligonucleotide
cctgacctcgtgatctgtct

SEQ ID NO: 8088 - DNA, 20 bp, Artificial Sequence
  Description of Artificial Sequence: Synthetic oligonucleotide
ctgacctcgtgatctgtctg

SEQ ID NO: 8089 - DNA, 20 bp, Artificial Sequence
  Description of Artificial Sequence: Synthetic oligonucleotide
tgacctcgtgatctgtctgc

SEQ ID NO: 8090 - DNA, 20 bp, Artificial Sequence
  Description of Artificial Sequence: Synthetic oligonucleotide
gacctcgtgatctgtctgcc

SEQ ID NO: 8091 - DNA, 20 bp, Artificial Sequence
  Description of Artificial Sequence: Synthetic oligonucleotide
acctcgtgatctgtctgcct

SEQ ID NO: 8092 - DNA, 20 bp, Artificial Sequence
  Description of Artificial Sequence: Synthetic oligonucleotide
cctcgtgatctgtctgcctc

SEQ ID NO: 8093 - DNA, 20 bp, Artificial Sequence
  Description of Artificial Sequence: Synthetic oligonucleotide
ctcgtgatctgtctgcctca

SEQ ID NO: 8094 - DNA, 20 bp, Artificial Sequence
  Description of Artificial Sequence: Synthetic oligonucleotide
tcgtgatctgtctgcctcaa

SEQ ID NO: 8095 - DNA, 20 bp, Artificial Sequence
  Description of Artificial Sequence: Synthetic oligonucleotide
cgtgatctgtctgcctcaac

SEQ ID NO: 8096 - DNA, 20 bp, Artificial Sequence
  Description of Artificial Sequence: Synthetic oligonucleotide
gtgatctgtctgcctcaacc

SEQ ID NO: 8097 - DNA, 20 bp, Artificial Sequence
  Description of Artificial Sequence: Synthetic oligonucleotide
tgatctgtctgcctcaacct

SEQ ID NO: 8098 - DNA, 20 bp, Artificial Sequence
  Description of Artificial Sequence: Synthetic oligonucleotide
gatctgtctgcctcaacctc

SEQ ID NO: 8099 - DNA, 20 bp, Artificial Sequence
  Description of Artificial Sequence: Synthetic oligonucleotide
atctgtctgcctcaacctcc

SEQ ID NO: 8100 - DNA, 20 bp, Artificial Sequence
  Description of Artificial Sequence: Synthetic oligonucleotide
tctgtctgcctcaacctccc

SEQ ID NO: 8101 - DNA, 20 bp, Artificial Sequence
  Description of Artificial Sequence: Synthetic oligonucleotide
ctgtctgcctcaacctccca

SEQ ID NO: 8102 - DNA, 20 bp, Artificial Sequence
  Description of Artificial Sequence: Synthetic oligonucleotide
tgtctgcctcaacctcccaa

SEQ ID NO: 8103 - DNA, 20 bp, Artificial Sequence
  Description of Artificial Sequence: Synthetic oligonucleotide
gtctgcctcaacctcccaaa

SEQ ID NO: 8104 - DNA, 20 bp, Artificial Sequence
  Description of Artificial Sequence: Synthetic oligonucleotide
tctgcctcaacctcccaaag

SEQ ID NO: 8105 - DNA, 20 bp, Artificial Sequence
  Description of Artificial Sequence: Synthetic oligonucleotide
ctgcctcaacctcccaaagt

SEQ ID NO: 8106 - DNA, 20 bp, Artificial Sequence
  Description of Artificial Sequence: Synthetic oligonucleotide
tgcctcaacctcccaaagtg

SEQ ID NO: 8107 - DNA, 20 bp, Artificial Sequence
  Description of Artificial Sequence: Synthetic oligonucleotide
gcctcaacctcccaaagtgc

SEQ ID NO: 8108 - DNA, 20 bp, Artificial Sequence
  Description of Artificial Sequence: Synthetic oligonucleotide
cctcaacctcccaaagtgct

SEQ ID NO: 8109 - DNA, 20 bp, Artificial Sequence
  Description of Artificial Sequence: Synthetic oligonucleotide
ctcaacctcccaaagtgctg

SEQ ID NO: 8110 - DNA, 20 bp, Artificial Sequence
  Description of Artificial Sequence: Synthetic oligonucleotide
tcaacctcccaaagtgctgg

SEQ ID NO: 8111 - DNA, 20 bp, Artificial Sequence
  Description of Artificial Sequence: Synthetic oligonucleotide
caacctcccaaagtgctggg

SEQ ID NO: 8112 - DNA, 20 bp, Artificial Sequence
  Description of Artificial Sequence: Synthetic oligonucleotide
aacctcccaaagtgctggga

SEQ ID NO: 8113 - DNA, 20 bp, Artificial Sequence
  Description of Artificial Sequence: Synthetic oligonucleotide
acctcccaaagtgctgggat

SEQ ID NO: 8114 - DNA, 20 bp, Artificial Sequence
  Description of Artificial Sequence: Synthetic oligonucleotide
cctcccaaagtgctgggatt

SEQ ID NO: 8115 - DNA, 20 bp, Artificial Sequence
  Description of Artificial Sequence: Synthetic oligonucleotide
ctcccaaagtgctgggatta

SEQ ID NO: 8116 - DNA, 20 bp, Artificial Sequence
  Description of Artificial Sequence: Synthetic oligonucleotide
tcccaaagtgctgggattac

SEQ ID NO: 8117 - DNA, 20 bp, Artificial Sequence
  Description of Artificial Sequence: Synthetic oligonucleotide
cccaaagtgctgggattaca

SEQ ID NO: 8118 - DNA, 20 bp, Artificial Sequence
  Description of Artificial Sequence: Synthetic oligonucleotide
ccaaagtgctgggattacag

SEQ ID NO: 8119 - DNA, 20 bp, Artificial Sequence
  Description of Artificial Sequence: Synthetic oligonucleotide
caaagtgctgggattacagg

SEQ ID NO: 8120 - DNA, 20 bp, Artificial Sequence
  Description of Artificial Sequence: Synthetic oligonucleotide
aaagtgctgggattacaggt

SEQ ID NO: 8121 - DNA, 20 bp, Artificial Sequence
  Description of Artificial Sequence: Synthetic oligonucleotide
aagtgctgggattacaggtg

SEQ ID NO: 8122 - DNA, 20 bp, Artificial Sequence
  Description of Artificial Sequence: Synthetic oligonucleotide
agtgctgggattacaggtgt

SEQ ID NO: 8123 - DNA, 20 bp, Artificial Sequence
  Description of Artificial Sequence: Synthetic oligonucleotide
gtgctgggattacaggtgtg

SEQ ID NO: 8124 - DNA, 20 bp, Artificial Sequence
  Description of Artificial Sequence: Synthetic oligonucleotide
tgctgggattacaggtgtga

SEQ ID NO: 8125 - DNA, 20 bp, Artificial Sequence
  Description of Artificial Sequence: Synthetic oligonucleotide
gctgggattacaggtgtgag

SEQ ID NO: 8126 - DNA, 20 bp, Artificial Sequence
  Description of Artificial Sequence: Synthetic oligonucleotide
ctgggattacaggtgtgagc

SEQ ID NO: 8127 - DNA, 20 bp, Artificial Sequence
  Description of Artificial Sequence: Synthetic oligonucleotide
tgggattacaggtgtgagcc

SEQ ID NO: 8128 - DNA, 20 bp, Artificial Sequence
  Description of Artificial Sequence: Synthetic oligonucleotide
gggattacaggtgtgagcca

SEQ ID NO: 8129 - DNA, 20 bp, Artificial Sequence
  Description of Artificial Sequence: Synthetic oligonucleotide
ggattacaggtgtgagccac

SEQ ID NO: 8130 - DNA, 20 bp, Artificial Sequence
  Description of Artificial Sequence: Synthetic oligonucleotide
gattacaggtgtgagccact

SEQ ID NO: 8131 - DNA, 20 bp, Artificial Sequence
  Description of Artificial Sequence: Synthetic oligonucleotide
attacaggtgtgagccactg

SEQ ID NO: 8132 - DNA, 20 bp, Artificial Sequence
  Description of Artificial Sequence: Synthetic oligonucleotide
ttacaggtgtgagccactgc

SEQ ID NO: 8133 - DNA, 20 bp, Artificial Sequence
  Description of Artificial Sequence: Synthetic oligonucleotide
tacaggtgtgagccactgca

SEQ ID NO: 8134 - DNA, 20 bp, Artificial Sequence
  Description of Artificial Sequence: Synthetic oligonucleotide
acaggtgtgagccactgcac

SEQ ID NO: 8135 - DNA, 20 bp, Artificial Sequence
  Description of Artificial Sequence: Synthetic oligonucleotide
caggtgtgagccactgcact

SEQ ID NO: 8136 - DNA, 20 bp, Artificial Sequence
  Description of Artificial Sequence: Synthetic oligonucleotide
aggtgtgagccactgcactt

SEQ ID NO: 8137 - DNA, 20 bp, Artificial Sequence
  Description of Artificial Sequence: Synthetic oligonucleotide
ggtgtgagccactgcacttg

SEQ ID NO: 8138 - DNA, 20 bp, Artificial Sequence
  Description of Artificial Sequence: Synthetic oligonucleotide
gtgtgagccactgcacttgg

SEQ ID NO: 8139 - DNA, 20 bp, Artificial Sequence
  Description of Artificial Sequence: Synthetic oligonucleotide
tgtgagccactgcacttggc

SEQ ID NO: 8140 - DNA, 20 bp, Artificial Sequence
  Description of Artificial Sequence: Synthetic oligonucleotide
gtgagccactgcacttggcc

SEQ ID NO: 8141 - DNA, 20 bp, Artificial Sequence
  Description of Artificial Sequence: Synthetic oligonucleotide
tgagccactgcacttggcct

SEQ ID NO: 8142 - DNA, 20 bp, Artificial Sequence
  Description of Artificial Sequence: Synthetic oligonucleotide
gagccactgcacttggcctt

SEQ ID NO: 8143 - DNA, 20 bp, Artificial Sequence
  Description of Artificial Sequence: Synthetic oligonucleotide
agccactgcacttggccttt

SEQ ID NO: 8144 - DNA, 20 bp, Artificial Sequence
  Description of Artificial Sequence: Synthetic oligonucleotide
gccactgcacttggcctttt

SEQ ID NO: 8145 - DNA, 20 bp, Artificial Sequence
  Description of Artificial Sequence: Synthetic oligonucleotide
ccactgcacttggccttttt

SEQ ID NO: 8146 - DNA, 20 bp, Artificial Sequence
  Description of Artificial Sequence: Synthetic oligonucleotide
cactgcacttggcctttttt

SEQ ID NO: 8147 - DNA, 20 bp, Artificial Sequence
  Description of Artificial Sequence: Synthetic oligonucleotide
actgcacttggccttttttt

SEQ ID NO: 8148 - DNA, 20 bp, Artificial Sequence
  Description of Artificial Sequence: Synthetic oligonucleotide
ctgcacttggcctttttttt

SEQ ID NO: 8149 - DNA, 20 bp, Artificial Sequence
  Description of Artificial Sequence: Synthetic oligonucleotide
tgcacttggccttttttttt

SEQ ID NO: 8150 - DNA, 20 bp, Artificial Sequence
  Description of Artificial Sequence: Synthetic oligonucleotide
gcacttggccttttttttta

SEQ ID NO: 8151 - DNA, 20 bp, Artificial Sequence
  Description of Artificial Sequence: Synthetic oligonucleotide
cacttggcctttttttttac

SEQ ID NO: 8152 - DNA, 20 bp, Artificial Sequence
  Description of Artificial Sequence: Synthetic oligonucleotide
acttggcctttttttttact

SEQ ID NO: 8153 - DNA, 20 bp, Artificial Sequence
  Description of Artificial Sequence: Synthetic oligonucleotide
cttggcctttttttttactt

SEQ ID NO: 8154 - DNA, 20 bp, Artificial Sequence
  Description of Artificial Sequence: Synthetic oligonucleotide
ttggcctttttttttacttt

SEQ ID NO: 8155 - DNA, 20 bp, Artificial Sequence
  Description of Artificial Sequence: Synthetic oligonucleotide
tggcctttttttttactttt

SEQ ID NO: 8156 - DNA, 20 bp, Artificial Sequence
  Description of Artificial Sequence: Synthetic oligonucleotide
ggcctttttttttactttta

SEQ ID NO: 8157 - DNA, 20 bp, Artificial Sequence
  Description of Artificial Sequence: Synthetic oligonucleotide
gcctttttttttacttttac

SEQ ID NO: 8158 - DNA, 20 bp, Artificial Sequence
  Description of Artificial Sequence: Synthetic oligonucleotide
cctttttttttacttttaca

SEQ ID NO: 8159 - DNA, 20 bp, Artificial Sequence
  Description of Artificial Sequence: Synthetic oligonucleotide
ctttttttttacttttacaa

SEQ ID NO: 8160 - DNA, 20 bp, Artificial Sequence
  Description of Artificial Sequence: Synthetic oligonucleotide
tttttttttacttttacaaa

SEQ ID NO: 8161 - DNA, 20 bp, Artificial Sequence
  Description of Artificial Sequence: Synthetic oligonucleotide
ttttttttacttttacaaaa

SEQ ID NO: 8162 - DNA, 20 bp, Artificial Sequence
  Description of Artificial Sequence: Synthetic oligonucleotide
tttttttacttttacaaaat

SEQ ID NO: 8163 - DNA, 20 bp, Artificial Sequence
  Description of Artificial Sequence: Synthetic oligonucleotide
ttttttacttttacaaaatt

SEQ ID NO: 8164 - DNA, 20 bp, Artificial Sequence
  Description of Artificial Sequence: Synthetic oligonucleotide
tttttacttttacaaaattt

SEQ ID NO: 8165 - DNA, 20 bp, Artificial Sequence
  Description of Artificial Sequence: Synthetic oligonucleotide
ttttacttttacaaaatttt

SEQ ID NO: 8166 - DNA, 20 bp, Artificial Sequence
  Description of Artificial Sequence: Synthetic oligonucleotide
tttacttttacaaaattttt

SEQ ID NO: 8167 - DNA, 20 bp, Artificial Sequence
  Description of Artificial Sequence: Synthetic oligonucleotide
ttacttttacaaaatttttt

SEQ ID NO: 8168 - DNA, 20 bp, Artificial Sequence
  Description of Artificial Sequence: Synthetic oligonucleotide
tacttttacaaaattttttg

SEQ ID NO: 8169 - DNA, 20 bp, Artificial Sequence
  Description of Artificial Sequence: Synthetic oligonucleotide
acttttacaaaattttttgt

SEQ ID NO: 8170 - DNA, 20 bp, Artificial Sequence
  Description of Artificial Sequence: Synthetic oligonucleotide
cttttacaaaattttttgta

SEQ ID NO: 8171 - DNA, 20 bp, Artificial Sequence
  Description of Artificial Sequence: Synthetic oligonucleotide
ttttacaaaattttttgtaa

SEQ ID NO: 8172 - DNA, 20 bp, Artificial Sequence
  Description of Artificial Sequence: Synthetic oligonucleotide
tttacaaaattttttgtaaa

SEQ ID NO: 8173 - DNA, 20 bp, Artificial Sequence
  Description of Artificial Sequence: Synthetic oligonucleotide
ttacaaaattttttgtaaag

SEQ ID NO: 8174 - DNA, 20 bp, Artificial Sequence
  Description of Artificial Sequence: Synthetic oligonucleotide
tacaaaattttttgtaaaga

SEQ ID NO: 8175 - DNA, 20 bp, Artificial Sequence
  Description of Artificial Sequence: Synthetic oligonucleotide
acaaaattttttgtaaagat

SEQ ID NO: 8176 - DNA, 20 bp, Artificial Sequence
  Description of Artificial Sequence: Synthetic oligonucleotide
caaaattttttgtaaagatg

SEQ ID NO: 8177 - DNA, 20 bp, Artificial Sequence
  Description of Artificial Sequence: Synthetic oligonucleotide
aaaattttttgtaaagatga

SEQ ID NO: 8178 - DNA, 20 bp, Artificial Sequence
  Description of Artificial Sequence: Synthetic oligonucleotide
aaattttttgtaaagatgag

SEQ ID NO: 8179 - DNA, 20 bp, Artificial Sequence
  Description of Artificial Sequence: Synthetic oligonucleotide
aattttttgtaaagatgagc

SEQ ID NO: 8180 - DNA, 20 bp, Artificial Sequence
  Description of Artificial Sequence: Synthetic oligonucleotide
attttttgtaaagatgagct

SEQ ID NO: 8181 - DNA, 20 bp, Artificial Sequence
  Description of Artificial Sequence: Synthetic oligonucleotide
ttttttgtaaagatgagctc

SEQ ID NO: 8182 - DNA, 20 bp, Artificial Sequence
  Description of Artificial Sequence: Synthetic oligonucleotide
tttttgtaaagatgagctct

SEQ ID NO: 8183 - DNA, 20 bp, Artificial Sequence
  Description of Artificial Sequence: Synthetic oligonucleotide
ttttgtaaagatgagctctc

SEQ ID NO: 8184 - DNA, 20 bp, Artificial Sequence
  Description of Artificial Sequence: Synthetic oligonucleotide
tttgtaaagatgagctctca

SEQ ID NO: 8185 - DNA, 20 bp, Artificial Sequence
  Description of Artificial Sequence: Synthetic oligonucleotide
ttgtaaagatgagctctcac

SEQ ID NO: 8186 - DNA, 20 bp, Artificial Sequence
  Description of Artificial Sequence: Synthetic oligonucleotide
tgtaaagatgagctctcact

SEQ ID NO: 8187 - DNA, 20 bp, Artificial Sequence
  Description of Artificial Sequence: Synthetic oligonucleotide
gtaaagatgagctctcacta

SEQ ID NO: 8188 - DNA, 20 bp, Artificial Sequence
  Description of Artificial Sequence: Synthetic oligonucleotide
taaagatgagctctcactat

SEQ ID NO: 8189 - DNA, 20 bp, Artificial Sequence
  Description of Artificial Sequence: Synthetic oligonucleotide
aaagatgagctctcactatg

SEQ ID NO: 8190 - DNA, 20 bp, Artificial Sequence
  Description of Artificial Sequence: Synthetic oligonucleotide
aagatgagctctcactatgt

SEQ ID NO: 8191 - DNA, 20 bp, Artificial Sequence
  Description of Artificial Sequence: Synthetic oligonucleotide
agatgagctctcactatgtt

SEQ ID NO: 8192 - DNA, 20 bp, Artificial Sequence
  Description of Artificial Sequence: Synthetic oligonucleotide
gatgagctctcactatgttg

SEQ ID NO: 8193 - DNA, 20 bp, Artificial Sequence
  Description of Artificial Sequence: Synthetic oligonucleotide
atgagctctcactatgttgt

SEQ ID NO: 8194 - DNA, 20 bp, Artificial Sequence
  Description of Artificial Sequence: Synthetic oligonucleotide
tgagctctcactatgttgtc

SEQ ID NO: 8195 - DNA, 20 bp, Artificial Sequence
  Description of Artificial Sequence: Synthetic oligonucleotide
gagctctcactatgttgtcc

SEQ ID NO: 8196 - DNA, 20 bp, Artificial Sequence
  Description of Artificial Sequence: Synthetic oligonucleotide
agctctcactatgttgtcca

SEQ ID NO: 8197 - DNA, 20 bp, Artificial Sequence
  Description of Artificial Sequence: Synthetic oligonucleotide
gctctcactatgttgtccag

SEQ ID NO: 8198 - DNA, 20 bp, Artificial Sequence
  Description of Artificial Sequence: Synthetic oligonucleotide
ctctcactatgttgtccagg

SEQ ID NO: 8199 - DNA, 20 bp, Artificial Sequence
  Description of Artificial Sequence: Synthetic oligonucleotide
tctcactatgttgtccaggc

SEQ ID NO: 8200 - DNA, 20 bp, Artificial Sequence
  Description of Artificial Sequence: Synthetic oligonucleotide
ctcactatgttgtccaggct

SEQ ID NO: 8201 - DNA, 20 bp, Artificial Sequence
  Description of Artificial Sequence: Synthetic oligonucleotide
tcactatgttgtccaggctg

SEQ ID NO: 8202 - DNA, 20 bp, Artificial Sequence
  Description of Artificial Sequence: Synthetic oligonucleotide
cactatgttgtccaggctgg

SEQ ID NO: 8203 - DNA, 20 bp, Artificial Sequence
  Description of Artificial Sequence: Synthetic oligonucleotide
actatgttgtccaggctggt

SEQ ID NO: 8204 - DNA, 20 bp, Artificial Sequence
  Description of Artificial Sequence: Synthetic oligonucleotide
ctatgttgtccaggctggtc

SEQ ID NO: 8205 - DNA, 20 bp, Artificial Sequence
  Description of Artificial Sequence: Synthetic oligonucleotide
tatgttgtccaggctggtct

SEQ ID NO: 8206 - DNA, 20 bp, Artificial Sequence
  Description of Artificial Sequence: Synthetic oligonucleotide
atgttgtccaggctggtctc

SEQ ID NO: 8207 - DNA, 20 bp, Artificial Sequence
  Description of Artificial Sequence: Synthetic oligonucleotide
tgttgtccaggctggtctcg

SEQ ID NO: 8208 - DNA, 20 bp, Artificial Sequence
  Description of Artificial Sequence: Synthetic oligonucleotide
gttgtccaggctggtctcga

SEQ ID NO: 8209 - DNA, 20 bp, Artificial Sequence
  Description of Artificial Sequence: Synthetic oligonucleotide
ttgtccaggctggtctcgaa

SEQ ID NO: 8210 - DNA, 20 bp, Artificial Sequence
  Description of Artificial Sequence: Synthetic oligonucleotide
tgtccaggctggtctcgaac

SEQ ID NO: 8211 - DNA, 20 bp, Artificial Sequence
  Description of Artificial Sequence: Synthetic oligonucleotide
gtccaggctggtctcgaact

SEQ ID NO: 8212 - DNA, 20 bp, Artificial Sequence
  Description of Artificial Sequence: Synthetic oligonucleotide
tccaggctggtctcgaactt

SEQ ID NO: 8213 - DNA, 20 bp, Artificial Sequence
  Description of Artificial Sequence: Synthetic oligonucleotide
ccaggctggtctcgaacttc

SEQ ID NO: 8214 - DNA, 20 bp, Artificial Sequence
  Description of Artificial Sequence: Synthetic oligonucleotide
caggctggtctcgaacttct

SEQ ID NO: 8215 - DNA, 20 bp, Artificial Sequence
  Description of Artificial Sequence: Synthetic oligonucleotide
aggctggtctcgaacttctg

SEQ ID NO: 8216 - DNA, 20 bp, Artificial Sequence
  Description of Artificial Sequence: Synthetic oligonucleotide
ggctggtctcgaacttctgg

SEQ ID NO: 8217 - DNA, 20 bp, Artificial Sequence
  Description of Artificial Sequence: Synthetic oligonucleotide
gctggtctcgaacttctggg

SEQ ID NO: 8218 - DNA, 20 bp, Artificial Sequence
  Description of Artificial Sequence: Synthetic oligonucleotide
ctggtctcgaacttctgggc

SEQ ID NO: 8219 - DNA, 20 bp, Artificial Sequence
  Description of Artificial Sequence: Synthetic oligonucleotide
tggtctcgaacttctgggct

SEQ ID NO: 8220 - DNA, 20 bp, Artificial Sequence
  Description of Artificial Sequence: Synthetic oligonucleotide
ggtctcgaacttctgggctc

SEQ ID NO: 8221 - DNA, 20 bp, Artificial Sequence
  Description of Artificial Sequence: Synthetic oligonucleotide
gtctcgaacttctgggctca

SEQ ID NO: 8222 - DNA, 20 bp, Artificial Sequence
  Description of Artificial Sequence: Synthetic oligonucleotide
tctcgaacttctgggctcaa

SEQ ID NO: 8223 - DNA, 20 bp, Artificial Sequence
  Description of Artificial Sequence: Synthetic oligonucleotide
ctcgaacttctgggctcaag

SEQ ID NO: 8224 - DNA, 20 bp, Artificial Sequence
  Description of Artificial Sequence: Synthetic oligonucleotide
tcgaacttctgggctcaagt

SEQ ID NO: 8225 - DNA, 20 bp, Artificial Sequence
  Description of Artificial Sequence: Synthetic oligonucleotide
cgaacttctgggctcaagtg

SEQ ID NO: 8226 - DNA, 20 bp, Artificial Sequence
  Description of Artificial Sequence: Synthetic oligonucleotide
gaacttctgggctcaagtga

SEQ ID NO: 8227 - DNA, 20 bp, Artificial Sequence
  Description of Artificial Sequence: Synthetic oligonucleotide
aacttctgggctcaagtgat

SEQ ID NO: 8228 - DNA, 20 bp, Artificial Sequence
  Description of Artificial Sequence: Synthetic oligonucleotide
acttctgggctcaagtgatc

SEQ ID NO: 8229 - DNA, 20 bp, Artificial Sequence
  Description of Artificial Sequence: Synthetic oligonucleotide
cttctgggctcaagtgatcc

SEQ ID NO: 8230 - DNA, 20 bp, Artificial Sequence
  Description of Artificial Sequence: Synthetic oligonucleotide
ttctgggctcaagtgatcct

SEQ ID NO: 8231 - DNA, 20 bp, Artificial Sequence
  Description of Artificial Sequence: Synthetic oligonucleotide
tctgggctcaagtgatcctc

SEQ ID NO: 8232 - DNA, 20 bp, Artificial Sequence
  Description of Artificial Sequence: Synthetic oligonucleotide
ctgggctcaagtgatcctca

SEQ ID NO: 8233 - DNA, 20 bp, Artificial Sequence
  Description of Artificial Sequence: Synthetic oligonucleotide
tgggctcaagtgatcctcat

SEQ ID NO: 8234 - DNA, 20 bp, Artificial Sequence
  Description of Artificial Sequence: Synthetic oligonucleotide
gggctcaagtgatcctcatg

SEQ ID NO: 8235 - DNA, 20 bp, Artificial Sequence
  Description of Artificial Sequence: Synthetic oligonucleotide
ggctcaagtgatcctcatga

SEQ ID NO: 8236 - DNA, 20 bp, Artificial Sequence
  Description of Artificial Sequence: Synthetic oligonucleotide
gctcaagtgatcctcatgat

SEQ ID NO: 8237 - DNA, 20 bp, Artificial Sequence
  Description of Artificial Sequence: Synthetic oligonucleotide
ctcaagtgatcctcatgata

SEQ ID NO: 8238 - DNA, 20 bp, Artificial Sequence
  Description of Artificial Sequence: Synthetic oligonucleotide
tcaagtgatcctcatgatag

SEQ ID NO: 8239 - DNA, 20 bp, Artificial Sequence
  Description of Artificial Sequence: Synthetic oligonucleotide
caagtgatcctcatgatagg

SEQ ID NO: 8240 - DNA, 20 bp, Artificial Sequence
  Description of Artificial Sequence: Synthetic oligonucleotide
aagtgatcctcatgataggc

SEQ ID NO: 8241 - DNA, 20 bp, Artificial Sequence
  Description of Artificial Sequence: Synthetic oligonucleotide
agtgatcctcatgataggcc

SEQ ID NO: 8242 - DNA, 20 bp, Artificial Sequence
  Description of Artificial Sequence: Synthetic oligonucleotide
gtgatcctcatgataggcct

SEQ ID NO: 8243 - DNA, 20 bp, Artificial Sequence
  Description of Artificial Sequence: Synthetic oligonucleotide
tgatcctcatgataggcctc

SEQ ID NO: 8244 - DNA, 20 bp, Artificial Sequence
  Description of Artificial Sequence: Synthetic oligonucleotide
gatcctcatgataggcctcc

SEQ ID NO: 8245 - DNA, 20 bp, Artificial Sequence
  Description of Artificial Sequence: Synthetic oligonucleotide
atcctcatgataggcctccc

SEQ ID NO: 8246 - DNA, 20 bp, Artificial Sequence
  Description of Artificial Sequence: Synthetic oligonucleotide
tcctcatgataggcctccca

SEQ ID NO: 8247 - DNA, 20 bp, Artificial Sequence
  Description of Artificial Sequence: Synthetic oligonucleotide
cctcatgataggcctcccaa

SEQ ID NO: 8248 - DNA, 20 bp, Artificial Sequence
  Description of Artificial Sequence: Synthetic oligonucleotide
ctcatgataggcctcccaaa

SEQ ID NO: 8249 - DNA, 20 bp, Artificial Sequence
  Description of Artificial Sequence: Synthetic oligonucleotide
tcatgataggcctcccaaag

SEQ ID NO: 8250 - DNA, 20 bp, Artificial Sequence
  Description of Artificial Sequence: Synthetic oligonucleotide
catgataggcctcccaaagt

SEQ ID NO: 8251 - DNA, 20 bp, Artificial Sequence
  Description of Artificial Sequence: Synthetic oligonucleotide
atgataggcctcccaaagtg

SEQ ID NO: 8252 - DNA, 20 bp, Artificial Sequence
  Description of Artificial Sequence: Synthetic oligonucleotide
tgataggcctcccaaagtgt

SEQ ID NO: 8253 - DNA, 20 bp, Artificial Sequence
  Description of Artificial Sequence: Synthetic oligonucleotide
gataggcctcccaaagtgtc

SEQ ID NO: 8254 - DNA, 20 bp, Artificial Sequence
  Description of Artificial Sequence: Synthetic oligonucleotide
ataggcctcccaaagtgtcg

SEQ ID NO: 8255 - DNA, 20 bp, Artificial Sequence
  Description of Artificial Sequence: Synthetic oligonucleotide
taggcctcccaaagtgtcgg

SEQ ID NO: 8256 - DNA, 20 bp, Artificial Sequence
  Description of Artificial Sequence: Synthetic oligonucleotide
aggcctcccaaagtgtcggg

SEQ ID NO: 8257 - DNA, 20 bp, Artificial Sequence
  Description of Artificial Sequence: Synthetic oligonucleotide
ggcctcccaaagtgtcggga

SEQ ID NO: 8258 - DNA, 20 bp, Artificial Sequence
  Description of Artificial Sequence: Synthetic oligonucleotide
gcctcccaaagtgtcgggat

SEQ ID NO: 8259 - DNA, 20 bp, Artificial Sequence
  Description of Artificial Sequence: Synthetic oligonucleotide
cctcccaaagtgtcgggatt

SEQ ID NO: 8260 - DNA, 20 bp, Artificial Sequence
  Description of Artificial Sequence: Synthetic oligonucleotide
ctcccaaagtgtcgggatta

SEQ ID NO: 8261 - DNA, 20 bp, Artificial Sequence
  Description of Artificial Sequence: Synthetic oligonucleotide
tcccaaagtgtcgggattac

SEQ ID NO: 8262 - DNA, 20 bp, Artificial Sequence
  Description of Artificial Sequence: Synthetic oligonucleotide
cccaaagtgtcgggattaca

SEQ ID NO: 8263 - DNA, 20 bp, Artificial Sequence
  Description of Artificial Sequence: Synthetic oligonucleotide
ccaaagtgtcgggattacag

SEQ ID NO: 8264 - DNA, 20 bp, Artificial Sequence
  Description of Artificial Sequence: Synthetic oligonucleotide
caaagtgtcgggattacaga

SEQ ID NO: 8265 - DNA, 20 bp, Artificial Sequence
  Description of Artificial Sequence: Synthetic oligonucleotide
aaagtgtcgggattacagat

SEQ ID NO: 8266 - DNA, 20 bp, Artificial Sequence
  Description of Artificial Sequence: Synthetic oligonucleotide
aagtgtcgggattacagata

SEQ ID NO: 8267 - DNA, 20 bp, Artificial Sequence
  Description of Artificial Sequence: Synthetic oligonucleotide
agtgtcgggattacagatat

SEQ ID NO: 8268 - DNA, 20 bp, Artificial Sequence
  Description of Artificial Sequence: Synthetic oligonucleotide
gtgtcgggattacagatatg

SEQ ID NO: 8269 - DNA, 20 bp, Artificial Sequence
  Description of Artificial Sequence: Synthetic oligonucleotide
tgtcgggattacagatatga

SEQ ID NO: 8270 - DNA, 20 bp, Artificial Sequence
  Description of Artificial Sequence: Synthetic oligonucleotide
gtcgggattacagatatgag

SEQ ID NO: 8271 - DNA, 20 bp, Artificial Sequence
  Description of Artificial Sequence: Synthetic oligonucleotide
tcgggattacagatatgagc

SEQ ID NO: 8272 - DNA, 20 bp, Artificial Sequence
  Description of Artificial Sequence: Synthetic oligonucleotide
cgggattacagatatgagcc

SEQ ID NO: 8273 - DNA, 20 bp, Artificial Sequence
  Description of Artificial Sequence: Synthetic oligonucleotide
gggattacagatatgagcca

SEQ ID NO: 8274 - DNA, 20 bp, Artificial Sequence
  Description of Artificial Sequence: Synthetic oligonucleotide
ggattacagatatgagccac

SEQ ID NO: 8275 - DNA, 20 bp, Artificial Sequence
  Description of Artificial Sequence: Synthetic oligonucleotide
gattacagatatgagccact

SEQ ID NO: 8276 - DNA, 20 bp, Artificial Sequence
  Description of Artificial Sequence: Synthetic oligonucleotide
attacagatatgagccacta

SEQ ID NO: 8277 - DNA, 20 bp, Artificial Sequence
  Description of Artificial Sequence: Synthetic oligonucleotide
ttacagatatgagccactac

SEQ ID NO: 8278 - DNA, 20 bp, Artificial Sequence
  Description of Artificial Sequence: Synthetic oligonucleotide
tacagatatgagccactaca

SEQ ID NO: 8279 - DNA, 20 bp, Artificial Sequence
  Description of Artificial Sequence: Synthetic oligonucleotide
acagatatgagccactacac

SEQ ID NO: 8280 - DNA, 20 bp, Artificial Sequence
  Description of Artificial Sequence: Synthetic oligonucleotide
cagatatgagccactacacc

SEQ ID NO: 8281 - DNA, 20 bp, Artificial Sequence
  Description of Artificial Sequence: Synthetic oligonucleotide
agatatgagccactacaccc

SEQ ID NO: 8282 - DNA, 20 bp, Artificial Sequence
  Description of Artificial Sequence: Synthetic oligonucleotide
gatatgagccactacaccca

SEQ ID NO: 8283 - DNA, 20 bp, Artificial Sequence
  Description of Artificial Sequence: Synthetic oligonucleotide
atatgagccactacacccag

SEQ ID NO: 8284 - DNA, 20 bp, Artificial Sequence
  Description of Artificial Sequence: Synthetic oligonucleotide
tatgagccactacacccaga

SEQ ID NO: 8285 - DNA, 20 bp, Artificial Sequence
  Description of Artificial Sequence: Synthetic oligonucleotide
atgagccactacacccagac

SEQ ID NO: 8286 - DNA, 20 bp, Artificial Sequence
  Description of Artificial Sequence: Synthetic oligonucleotide
tgagccactacacccagaca

SEQ ID NO: 8287 - DNA, 20 bp, Artificial Sequence
  Description of Artificial Sequence: Synthetic oligonucleotide
gagccactacacccagacaa

SEQ ID NO: 8288 - DNA, 20 bp, Artificial Sequence
  Description of Artificial Sequence: Synthetic oligonucleotide
agccactacacccagacaag

SEQ ID NO: 8289 - DNA, 20 bp, Artificial Sequence
  Description of Artificial Sequence: Synthetic oligonucleotide
gccactacacccagacaagg

SEQ ID NO: 8290 - DNA, 20 bp, Artificial Sequence
  Description of Artificial Sequence: Synthetic oligonucleotide
ccactacacccagacaaggg

SEQ ID NO: 8291 - DNA, 20 bp, Artificial Sequence
  Description of Artificial Sequence: Synthetic oligonucleotide
cactacacccagacaagggc

SEQ ID NO: 8292 - DNA, 20 bp, Artificial Sequence
  Description of Artificial Sequence: Synthetic oligonucleotide
actacacccagacaagggct

SEQ ID NO: 8293 - DNA, 20 bp, Artificial Sequence
  Description of Artificial Sequence: Synthetic oligonucleotide
ctacacccagacaagggctg

SEQ ID NO: 8294 - DNA, 20 bp, Artificial Sequence
  Description of Artificial Sequence: Synthetic oligonucleotide
tacacccagacaagggctgc

SEQ ID NO: 8295 - DNA, 20 bp, Artificial Sequence
  Description of Artificial Sequence: Synthetic oligonucleotide
acacccagacaagggctgca

SEQ ID NO: 8296 - DNA, 20 bp, Artificial Sequence
  Description of Artificial Sequence: Synthetic oligonucleotide
cacccagacaagggctgcat

SEQ ID NO: 8297 - DNA, 20 bp, Artificial Sequence
  Description of Artificial Sequence: Synthetic oligonucleotide
acccagacaagggctgcatt

SEQ ID NO: 8298 - DNA, 20 bp, Artificial Sequence
  Description of Artificial Sequence: Synthetic oligonucleotide
cccagacaagggctgcattt

SEQ ID NO: 8299 - DNA, 20 bp, Artificial Sequence
  Description of Artificial Sequence: Synthetic oligonucleotide
ccagacaagggctgcatttt

SEQ ID NO: 8300 - DNA, 20 bp, Artificial Sequence
  Description of Artificial Sequence: Synthetic oligonucleotide
cagacaagggctgcatttta

SEQ ID NO: 8301 - DNA, 20 bp, Artificial Sequence
  Description of Artificial Sequence: Synthetic oligonucleotide
agacaagggctgcattttaa

SEQ ID NO: 8302 - DNA, 20 bp, Artificial Sequence
  Description of Artificial Sequence: Synthetic oligonucleotide
gacaagggctgcattttaaa

SEQ ID NO: 8303 - DNA, 20 bp, Artificial Sequence
  Description of Artificial Sequence: Synthetic oligonucleotide
acaagggctgcattttaaag

SEQ ID NO: 8304 - DNA, 20 bp, Artificial Sequence
  Description of Artificial Sequence: Synthetic oligonucleotide
caagggctgcattttaaaga

SEQ ID NO: 8305 - DNA, 20 bp, Artificial Sequence
  Description of Artificial Sequence: Synthetic oligonucleotide
aagggctgcattttaaagaa

SEQ ID NO: 8306 - DNA, 20 bp, Artificial Sequence
  Description of Artificial Sequence: Synthetic oligonucleotide
agggctgcattttaaagaaa

SEQ ID NO: 8307 - DNA, 20 bp, Artificial Sequence
  Description of Artificial Sequence: Synthetic oligonucleotide
gggctgcattttaaagaaaa

SEQ ID NO: 8308 - DNA, 20 bp, Artificial Sequence
  Description of Artificial Sequence: Synthetic oligonucleotide
ggctgcattttaaagaaaag

SEQ ID NO: 8309 - DNA, 20 bp, Artificial Sequence
  Description of Artificial Sequence: Synthetic oligonucleotide
gctgcattttaaagaaaaga

SEQ ID NO: 8310 - DNA, 20 bp, Artificial Sequence
  Description of Artificial Sequence: Synthetic oligonucleotide
ctgcattttaaagaaaagag

SEQ ID NO: 8311 - DNA, 20 bp, Artificial Sequence
  Description of Artificial Sequence: Synthetic oligonucleotide
tgcattttaaagaaaagagg

SEQ ID NO: 8312 - DNA, 20 bp, Artificial Sequence
  Description of Artificial Sequence: Synthetic oligonucleotide
gcattttaaagaaaagaggc

SEQ ID NO: 8313 - DNA, 20 bp, Artificial Sequence
  Description of Artificial Sequence: Synthetic oligonucleotide
cattttaaagaaaagaggcc

SEQ ID NO: 8314 - DNA, 20 bp, Artificial Sequence
  Description of Artificial Sequence: Synthetic oligonucleotide
attttaaagaaaagaggcca

SEQ ID NO: 8315 - DNA, 20 bp, Artificial Sequence
  Description of Artificial Sequence: Synthetic oligonucleotide
ttttaaagaaaagaggccag

SEQ ID NO: 8316 - DNA, 20 bp, Artificial Sequence
  Description of Artificial Sequence: Synthetic oligonucleotide
tttaaagaaaagaggccagg

SEQ ID NO: 8317 - DNA, 20 bp, Artificial Sequence
  Description of Artificial Sequence: Synthetic oligonucleotide
ttaaagaaaagaggccagga

SEQ ID NO: 8318 - DNA, 20 bp, Artificial Sequence
  Description of Artificial Sequence: Synthetic oligonucleotide
taaagaaaagaggccaggag

SEQ ID NO: 8319 - DNA, 20 bp, Artificial Sequence
  Description of Artificial Sequence: Synthetic oligonucleotide
aaagaaaagaggccaggagc

SEQ ID NO: 8320 - DNA, 20 bp, Artificial Sequence
  Description of Artificial Sequence: Synthetic oligonucleotide
aagaaaagaggccaggagca

SEQ ID NO: 8321 - DNA, 20 bp, Artificial Sequence
  Description of Artificial Sequence: Synthetic oligonucleotide
agaaaagaggccaggagcag

SEQ ID NO: 8322 - DNA, 20 bp, Artificial Sequence
  Description of Artificial Sequence: Synthetic oligonucleotide
gaaaagaggccaggagcagt

SEQ ID NO: 8323 - DNA, 20 bp, Artificial Sequence
  Description of Artificial Sequence: Synthetic oligonucleotide
aaaagaggccaggagcagtg

SEQ ID NO: 8324 - DNA, 20 bp, Artificial Sequence
  Description of Artificial Sequence: Synthetic oligonucleotide
aaagaggccaggagcagtgg

SEQ ID NO: 8325 - DNA, 20 bp, Artificial Sequence
  Description of Artificial Sequence: Synthetic oligonucleotide
aagaggccaggagcagtggc

SEQ ID NO: 8326 - DNA, 20 bp, Artificial Sequence
  Description of Artificial Sequence: Synthetic oligonucleotide
agaggccaggagcagtggct

SEQ ID NO: 8327 - DNA, 20 bp, Artificial Sequence
  Description of Artificial Sequence: Synthetic oligonucleotide
gaggccaggagcagtggcta

SEQ ID NO: 8328 - DNA, 20 bp, Artificial Sequence
  Description of Artificial Sequence: Synthetic oligonucleotide
aggccaggagcagtggctaa

SEQ ID NO: 8329 - DNA, 20 bp, Artificial Sequence
  Description of Artificial Sequence: Synthetic oligonucleotide
ggccaggagcagtggctaat

SEQ ID NO: 8330 - DNA, 20 bp, Artificial Sequence
  Description of Artificial Sequence: Synthetic oligonucleotide
gccaggagcagtggctaatg

SEQ ID NO: 8331 - DNA, 20 bp, Artificial Sequence
  Description of Artificial Sequence: Synthetic oligonucleotide
ccaggagcagtggctaatgc

SEQ ID NO: 8332 - DNA, 20 bp, Artificial Sequence
  Description of Artificial Sequence: Synthetic oligonucleotide
caggagcagtggctaatgcc

SEQ ID NO: 8333 - DNA, 20 bp, Artificial Sequence
  Description of Artificial Sequence: Synthetic oligonucleotide
aggagcagtggctaatgcct

SEQ ID NO: 8334 - DNA, 20 bp, Artificial Sequence
  Description of Artificial Sequence: Synthetic oligonucleotide
ggagcagtggctaatgccta

SEQ ID NO: 8335 - DNA, 20 bp, Artificial Sequence
  Description of Artificial Sequence: Synthetic oligonucleotide
gagcagtggctaatgcctat

SEQ ID NO: 8336 - DNA, 20 bp, Artificial Sequence
  Description of Artificial Sequence: Synthetic oligonucleotide
agcagtggctaatgcctata

SEQ ID NO: 8337 - DNA, 20 bp, Artificial Sequence
  Description of Artificial Sequence: Synthetic oligonucleotide
gcagtggctaatgcctataa

SEQ ID NO: 8338 - DNA, 20 bp, Artificial Sequence
  Description of Artificial Sequence: Synthetic oligonucleotide
cagtggctaatgcctataat

SEQ ID NO: 8339 - DNA, 20 bp, Artificial Sequence
  Description of Artificial Sequence: Synthetic oligonucleotide
agtggctaatgcctataatc

SEQ ID NO: 8340 - DNA, 20 bp, Artificial Sequence
  Description of Artificial Sequence: Synthetic oligonucleotide
gtggctaatgcctataatcc

SEQ ID NO: 8341 - DNA, 20 bp, Artificial Sequence
  Description of Artificial Sequence: Synthetic oligonucleotide
tggctaatgcctataatccc

SEQ ID NO: 8342 - DNA, 20 bp, Artificial Sequence
  Description of Artificial Sequence: Synthetic oligonucleotide
ggctaatgcctataatccca

SEQ ID NO: 8343 - DNA, 20 bp, Artificial Sequence
  Description of Artificial Sequence: Synthetic oligonucleotide
gctaatgcctataatcccag

SEQ ID NO: 8344 - DNA, 20 bp, Artificial Sequence
  Description of Artificial Sequence: Synthetic oligonucleotide
ctaatgcctataatcccagc

SEQ ID NO: 8345 - DNA, 20 bp, Artificial Sequence
  Description of Artificial Sequence: Synthetic oligonucleotide
taatgcctataatcccagca

SEQ ID NO: 8346 - DNA, 20 bp, Artificial Sequence
  Description of Artificial Sequence: Synthetic oligonucleotide
aatgcctataatcccagcat

SEQ ID NO: 8347 - DNA, 20 bp, Artificial Sequence
  Description of Artificial Sequence: Synthetic oligonucleotide
atgcctataatcccagcatt

SEQ ID NO: 8348 - DNA, 20 bp, Artificial Sequence
  Description of Artificial Sequence: Synthetic oligonucleotide
tgcctataatcccagcattt

SEQ ID NO: 8349 - DNA, 20 bp, Artificial Sequence
  Description of Artificial Sequence: Synthetic oligonucleotide
gcctataatcccagcatttt

SEQ ID NO: 8350 - DNA, 20 bp, Artificial Sequence
  Description of Artificial Sequence: Synthetic oligonucleotide
cctataatcccagcattttg

SEQ ID NO: 8351 - DNA, 20 bp, Artificial Sequence
  Description of Artificial Sequence: Synthetic oligonucleotide
ctataatcccagcattttgg

SEQ ID NO: 8352 - DNA, 20 bp, Artificial Sequence
  Description of Artificial Sequence: Synthetic oligonucleotide
tataatcccagcattttggg

SEQ ID NO: 8353 - DNA, 20 bp, Artificial Sequence
  Description of Artificial Sequence: Synthetic oligonucleotide
ataatcccagcattttggga

SEQ ID NO: 8354 - DNA, 20 bp, Artificial Sequence
  Description of Artificial Sequence: Synthetic oligonucleotide
taatcccagcattttgggag

SEQ ID NO: 8355 - DNA, 20 bp, Artificial Sequence
  Description of Artificial Sequence: Synthetic oligonucleotide
aatcccagcattttgggagg

SEQ ID NO: 8356 - DNA, 20 bp, Artificial Sequence
  Description of Artificial Sequence: Synthetic oligonucleotide
atcccagcattttgggaggc

SEQ ID NO: 8357 - DNA, 20 bp, Artificial Sequence
  Description of Artificial Sequence: Synthetic oligonucleotide
tcccagcattttgggaggcc

SEQ ID NO: 8358 - DNA, 20 bp, Artificial Sequence
  Description of Artificial Sequence: Synthetic oligonucleotide
cccagcattttgggaggcca

SEQ ID NO: 8359 - DNA, 20 bp, Artificial Sequence
  Description of Artificial Sequence: Synthetic oligonucleotide
ccagcattttgggaggccaa

SEQ ID NO: 8360 - DNA, 20 bp, Artificial Sequence
  Description of Artificial Sequence: Synthetic oligonucleotide
cagcattttgggaggccaaa

SEQ ID NO: 8361 - DNA, 20 bp, Artificial Sequence
  Description of Artificial Sequence: Synthetic oligonucleotide
agcattttgggaggccaaag

SEQ ID NO: 8362 - DNA, 20 bp, Artificial Sequence
  Description of Artificial Sequence: Synthetic oligonucleotide
gcattttgggaggccaaagt

SEQ ID NO: 8363 - DNA, 20 bp, Artificial Sequence
  Description of Artificial Sequence: Synthetic oligonucleotide
cattttgggaggccaaagtc

SEQ ID NO: 8364 - DNA, 20 bp, Artificial Sequence
  Description of Artificial Sequence: Synthetic oligonucleotide
attttgggaggccaaagtcg

SEQ ID NO: 8365 - DNA, 20 bp, Artificial Sequence
  Description of Artificial Sequence: Synthetic oligonucleotide
ttttgggaggccaaagtcgg

SEQ ID NO: 8366 - DNA, 20 bp, Artificial Sequence
  Description of Artificial Sequence: Synthetic oligonucleotide
tttgggaggccaaagtcggc

SEQ ID NO: 8367 - DNA, 20 bp, Artificial Sequence
  Description of Artificial Sequence: Synthetic oligonucleotide
ttgggaggccaaagtcggca

SEQ ID NO: 8368 - DNA, 20 bp, Artificial Sequence
  Description of Artificial Sequence: Synthetic oligonucleotide
tgggaggccaaagtcggcaa

SEQ ID NO: 8369 - DNA, 20 bp, Artificial Sequence
  Description of Artificial Sequence: Synthetic oligonucleotide
gggaggccaaagtcggcaaa

SEQ ID NO: 8370 - DNA, 20 bp, Artificial Sequence
  Description of Artificial Sequence: Synthetic oligonucleotide
ggaggccaaagtcggcaaat

SEQ ID NO: 8371 - DNA, 20 bp, Artificial Sequence
  Description of Artificial Sequence: Synthetic oligonucleotide
gaggccaaagtcggcaaatc

SEQ ID NO: 8372 - DNA, 20 bp, Artificial Sequence
  Description of Artificial Sequence: Synthetic oligonucleotide
aggccaaagtcggcaaatca

SEQ ID NO: 8373 - DNA, 20 bp, Artificial Sequence
  Description of Artificial Sequence: Synthetic oligonucleotide
ggccaaagtcggcaaatcat

SEQ ID NO: 8374 - DNA, 20 bp, Artificial Sequence
  Description of Artificial Sequence: Synthetic oligonucleotide
gccaaagtcggcaaatcatt

SEQ ID NO: 8375 - DNA, 20 bp, Artificial Sequence
  Description of Artificial Sequence: Synthetic oligonucleotide
ccaaagtcggcaaatcattt

SEQ ID NO: 8376 - DNA, 20 bp, Artificial Sequence
  Description of Artificial Sequence: Synthetic oligonucleotide
caaagtcggcaaatcatttg

SEQ ID NO: 8377 - DNA, 20 bp, Artificial Sequence
  Description of Artificial Sequence: Synthetic oligonucleotide
aaagtcggcaaatcatttga

SEQ ID NO: 8378 - DNA, 20 bp, Artificial Sequence
  Description of Artificial Sequence: Synthetic oligonucleotide
aagtcggcaaatcatttgag

SEQ ID NO: 8379 - DNA, 20 bp, Artificial Sequence
  Description of Artificial Sequence: Synthetic oligonucleotide
agtcggcaaatcatttgagg

SEQ ID NO: 8380 - DNA, 20 bp, Artificial Sequence
  Description of Artificial Sequence: Synthetic oligonucleotide
gtcggcaaatcatttgaggt

SEQ ID NO: 8381 - DNA, 20 bp, Artificial Sequence
  Description of Artificial Sequence: Synthetic oligonucleotide
tcggcaaatcatttgaggtc

SEQ ID NO: 8382 - DNA, 20 bp, Artificial Sequence
  Description of Artificial Sequence: Synthetic oligonucleotide
cggcaaatcatttgaggtca

SEQ ID NO: 8383 - DNA, 20 bp, Artificial Sequence
  Description of Artificial Sequence: Synthetic oligonucleotide
ggcaaatcatttgaggtcag

SEQ ID NO: 8384 - DNA, 20 bp, Artificial Sequence
  Description of Artificial Sequence: Synthetic oligonucleotide
gcaaatcatttgaggtcagg

SEQ ID NO: 8385 - DNA, 20 bp, Artificial Sequence
  Description of Artificial Sequence: Synthetic oligonucleotide
caaatcatttgaggtcagga

SEQ ID NO: 8386 - DNA, 20 bp, Artificial Sequence
  Description of Artificial Sequence: Synthetic oligonucleotide
aaatcatttgaggtcaggag

SEQ ID NO: 8387 - DNA, 20 bp, Artificial Sequence
  Description of Artificial Sequence: Synthetic oligonucleotide
aatcatttgaggtcaggagt

SEQ ID NO: 8388 - DNA, 20 bp, Artificial Sequence
  Description of Artificial Sequence: Synthetic oligonucleotide
atcatttgaggtcaggagtt

SEQ ID NO: 8389 - DNA, 20 bp, Artificial Sequence
  Description of Artificial Sequence: Synthetic oligonucleotide
tcatttgaggtcaggagttt

SEQ ID NO: 8390 - DNA, 20 bp, Artificial Sequence
  Description of Artificial Sequence: Synthetic oligonucleotide
catttgaggtcaggagtttg

SEQ ID NO: 8391 - DNA, 20 bp, Artificial Sequence
  Description of Artificial Sequence: Synthetic oligonucleotide
atttgaggtcaggagtttga

SEQ ID NO: 8392 - DNA, 20 bp, Artificial Sequence
  Description of Artificial Sequence: Synthetic oligonucleotide
tttgaggtcaggagtttgag

SEQ ID NO: 8393 - DNA, 20 bp, Artificial Sequence
  Description of Artificial Sequence: Synthetic oligonucleotide
ttgaggtcaggagtttgaga

SEQ ID NO: 8394 - DNA, 20 bp, Artificial Sequence
  Description of Artificial Sequence: Synthetic oligonucleotide
tgaggtcaggagtttgagac

SEQ ID NO: 8395 - DNA, 20 bp, Artificial Sequence
  Description of Artificial Sequence: Synthetic oligonucleotide
gaggtcaggagtttgagacc

SEQ ID NO: 8396 - DNA, 20 bp, Artificial Sequence
  Description of Artificial Sequence: Synthetic oligonucleotide
aggtcaggagtttgagacca

SEQ ID NO: 8397 - DNA, 20 bp, Artificial Sequence
  Description of Artificial Sequence: Synthetic oligonucleotide
ggtcaggagtttgagaccag

SEQ ID NO: 8398 - DNA, 20 bp, Artificial Sequence
  Description of Artificial Sequence: Synthetic oligonucleotide
gtcaggagtttgagaccagc

SEQ ID NO: 8399 - DNA, 20 bp, Artificial Sequence
  Description of Artificial Sequence: Synthetic oligonucleotide
tcaggagtttgagaccagcc

SEQ ID NO: 8400 - DNA, 20 bp, Artificial Sequence
  Description of Artificial Sequence: Synthetic oligonucleotide
caggagtttgagaccagcca

SEQ ID NO: 8401 - DNA, 20 bp, Artificial Sequence
  Description of Artificial Sequence: Synthetic oligonucleotide
aggagtttgagaccagccag

SEQ ID NO: 8402 - DNA, 20 bp, Artificial Sequence
  Description of Artificial Sequence: Synthetic oligonucleotide
ggagtttgagaccagccaga

SEQ ID NO: 8403 - DNA, 20 bp, Artificial Sequence
  Description of Artificial Sequence: Synthetic oligonucleotide
gagtttgagaccagccagac

SEQ ID NO: 8404 - DNA, 20 bp, Artificial Sequence
  Description of Artificial Sequence: Synthetic oligonucleotide
agtttgagaccagccagacc

SEQ ID NO: 8405 - DNA, 20 bp, Artificial Sequence
  Description of Artificial Sequence: Synthetic oligonucleotide
gtttgagaccagccagacca

SEQ ID NO: 8406 - DNA, 20 bp, Artificial Sequence
  Description of Artificial Sequence: Synthetic oligonucleotide
tttgagaccagccagaccaa

SEQ ID NO: 8407 - DNA, 20 bp, Artificial Sequence
  Description of Artificial Sequence: Synthetic oligonucleotide
ttgagaccagccagaccaac

SEQ ID NO: 8408 - DNA, 20 bp, Artificial Sequence
  Description of Artificial Sequence: Synthetic oligonucleotide
tgagaccagccagaccaaca

SEQ ID NO: 8409 - DNA, 20 bp, Artificial Sequence
  Description of Artificial Sequence: Synthetic oligonucleotide
gagaccagccagaccaacat

SEQ ID NO: 8410 - DNA, 20 bp, Artificial Sequence
  Description of Artificial Sequence: Synthetic oligonucleotide
agaccagccagaccaacatg

SEQ ID NO: 8411 - DNA, 20 bp, Artificial Sequence
  Description of Artificial Sequence: Synthetic oligonucleotide
gaccagccagaccaacatgg

SEQ ID NO: 8412 - DNA, 20 bp, Artificial Sequence
  Description of Artificial Sequence: Synthetic oligonucleotide
accagccagaccaacatggt

SEQ ID NO: 8413 - DNA, 20 bp, Artificial Sequence
  Description of Artificial Sequence: Synthetic oligonucleotide
ccagccagaccaacatggtg

SEQ ID NO: 8414 - DNA, 20 bp, Artificial Sequence
  Description of Artificial Sequence: Synthetic oligonucleotide
cagccagaccaacatggtga

SEQ ID NO: 8415 - DNA, 20 bp, Artificial Sequence
  Description of Artificial Sequence: Synthetic oligonucleotide
agccagaccaacatggtgaa

SEQ ID NO: 8416 - DNA, 20 bp, Artificial Sequence
  Description of Artificial Sequence: Synthetic oligonucleotide
gccagaccaacatggtgaaa

SEQ ID NO: 8417 - DNA, 20 bp, Artificial Sequence
  Description of Artificial Sequence: Synthetic oligonucleotide
ccagaccaacatggtgaaac

SEQ ID NO: 8418 - DNA, 20 bp, Artificial Sequence
  Description of Artificial Sequence: Synthetic oligonucleotide
cagaccaacatggtgaaacc

SEQ ID NO: 8419 - DNA, 20 bp, Artificial Sequence
  Description of Artificial Sequence: Synthetic oligonucleotide
agaccaacatggtgaaaccc

SEQ ID NO: 8420 - DNA, 20 bp, Artificial Sequence
  Description of Artificial Sequence: Synthetic oligonucleotide
gaccaacatggtgaaaccca

SEQ ID NO: 8421 - DNA, 20 bp, Artificial Sequence
  Description of Artificial Sequence: Synthetic oligonucleotide
accaacatggtgaaacccag

SEQ ID NO: 8422 - DNA, 20 bp, Artificial Sequence
  Description of Artificial Sequence: Synthetic oligonucleotide
ccaacatggtgaaacccagt

SEQ ID NO: 8423 - DNA, 20 bp, Artificial Sequence
  Description of Artificial Sequence: Synthetic oligonucleotide
caacatggtgaaacccagtc

SEQ ID NO: 8424 - DNA, 20 bp, Artificial Sequence
  Description of Artificial Sequence: Synthetic oligonucleotide
aacatggtgaaacccagtct

SEQ ID NO: 8425 - DNA, 20 bp, Artificial Sequence
  Description of Artificial Sequence: Synthetic oligonucleotide
acatggtgaaacccagtctc

SEQ ID NO: 8426 - DNA, 20 bp, Artificial Sequence
  Description of Artificial Sequence: Synthetic oligonucleotide
catggtgaaacccagtctct

SEQ ID NO: 8427 - DNA, 20 bp, Artificial Sequence
  Description of Artificial Sequence: Synthetic oligonucleotide
atggtgaaacccagtctcta

SEQ ID NO: 8428 - DNA, 20 bp, Artificial Sequence
  Description of Artificial Sequence: Synthetic oligonucleotide
tggtgaaacccagtctctac

SEQ ID NO: 8429 - DNA, 20 bp, Artificial Sequence
  Description of Artificial Sequence: Synthetic oligonucleotide
ggtgaaacccagtctctact

SEQ ID NO: 8430 - DNA, 20 bp, Artificial Sequence
  Description of Artificial Sequence: Synthetic oligonucleotide
gtgaaacccagtctctacta

SEQ ID NO: 8431 - DNA, 20 bp, Artificial Sequence
  Description of Artificial Sequence: Synthetic oligonucleotide
tgaaacccagtctctactaa

SEQ ID NO: 8432 - DNA, 20 bp, Artificial Sequence
  Description of Artificial Sequence: Synthetic oligonucleotide
gaaacccagtctctactaaa

SEQ ID NO: 8433 - DNA, 20 bp, Artificial Sequence
  Description of Artificial Sequence: Synthetic oligonucleotide
aaacccagtctctactaaaa

SEQ ID NO: 8434 - DNA, 20 bp, Artificial Sequence
  Description of Artificial Sequence: Synthetic oligonucleotide
aacccagtctctactaaaaa

SEQ ID NO: 8435 - DNA, 20 bp, Artificial Sequence
  Description of Artificial Sequence: Synthetic oligonucleotide
acccagtctctactaaaaat

SEQ ID NO: 8436 - DNA, 20 bp, Artificial Sequence
  Description of Artificial Sequence: Synthetic oligonucleotide
cccagtctctactaaaaata

SEQ ID NO: 8437 - DNA, 20 bp, Artificial Sequence
  Description of Artificial Sequence: Synthetic oligonucleotide
ccagtctctactaaaaatac

SEQ ID NO: 8438 - DNA, 20 bp, Artificial Sequence
  Description of Artificial Sequence: Synthetic oligonucleotide
cagtctctactaaaaataca

SEQ ID NO: 8439 - DNA, 20 bp, Artificial Sequence
  Description of Artificial Sequence: Synthetic oligonucleotide
agtctctactaaaaatacaa

SEQ ID NO: 8440 - DNA, 20 bp, Artificial Sequence
  Description of Artificial Sequence: Synthetic oligonucleotide
gtctctactaaaaatacaaa

SEQ ID NO: 8441 - DNA, 20 bp, Artificial Sequence
  Description of Artificial Sequence: Synthetic oligonucleotide
tctctactaaaaatacaaaa

SEQ ID NO: 8442 - DNA, 20 bp, Artificial Sequence
  Description of Artificial Sequence: Synthetic oligonucleotide
ctctactaaaaatacaaaaa

SEQ ID NO: 8443 - DNA, 20 bp, Artificial Sequence
  Description of Artificial Sequence: Synthetic oligonucleotide
tctactaaaaatacaaaaat

SEQ ID NO: 8444 - DNA, 20 bp, Artificial Sequence
  Description of Artificial Sequence: Synthetic oligonucleotide
ctactaaaaatacaaaaatt

SEQ ID NO: 8445 - DNA, 20 bp, Artificial Sequence
  Description of Artificial Sequence: Synthetic oligonucleotide
tactaaaaatacaaaaatta

SEQ ID NO: 8446 - DNA, 20 bp, Artificial Sequence
  Description of Artificial Sequence: Synthetic oligonucleotide
actaaaaatacaaaaattag

SEQ ID NO: 8447 - DNA, 20 bp, Artificial Sequence
  Description of Artificial Sequence: Synthetic oligonucleotide
ctaaaaatacaaaaattagc

SEQ ID NO: 8448 - DNA, 20 bp, Artificial Sequence
  Description of Artificial Sequence: Synthetic oligonucleotide
taaaaatacaaaaattagct

SEQ ID NO: 8449 - DNA, 20 bp, Artificial Sequence
  Description of Artificial Sequence: Synthetic oligonucleotide
aaaaatacaaaaattagctg

SEQ ID NO: 8450 - DNA, 20 bp, Artificial Sequence
  Description of Artificial Sequence: Synthetic oligonucleotide
aaaatacaaaaattagctgg

SEQ ID NO: 8451 - DNA, 20 bp, Artificial Sequence
  Description of Artificial Sequence: Synthetic oligonucleotide
aaatacaaaaattagctggg

SEQ ID NO: 8452 - DNA, 20 bp, Artificial Sequence
  Description of Artificial Sequence: Synthetic oligonucleotide
aatacaaaaattagctgggt

SEQ ID NO: 8453 - DNA, 20 bp, Artificial Sequence
  Description of Artificial Sequence: Synthetic oligonucleotide
atacaaaaattagctgggtg

SEQ ID NO: 8454 - DNA, 20 bp, Artificial Sequence
  Description of Artificial Sequence: Synthetic oligonucleotide
tacaaaaattagctgggtgt

SEQ ID NO: 8455 - DNA, 20 bp, Artificial Sequence
  Description of Artificial Sequence: Synthetic oligonucleotide
acaaaaattagctgggtgtg

SEQ ID NO: 8456 - DNA, 20 bp, Artificial Sequence
  Description of Artificial Sequence: Synthetic oligonucleotide
caaaaattagctgggtgtgg

SEQ ID NO: 8457 - DNA, 20 bp, Artificial Sequence
  Description of Artificial Sequence: Synthetic oligonucleotide
aaaaattagctgggtgtggt

SEQ ID NO: 8458 - DNA, 20 bp, Artificial Sequence
  Description of Artificial Sequence: Synthetic oligonucleotide
aaaattagctgggtgtggtt

SEQ ID NO: 8459 - DNA, 20 bp, Artificial Sequence
  Description of Artificial Sequence: Synthetic oligonucleotide
aaattagctgggtgtggttg

SEQ ID NO: 8460 - DNA, 20 bp, Artificial Sequence
  Description of Artificial Sequence: Synthetic oligonucleotide
aattagctgggtgtggttgc

SEQ ID NO: 8461 - DNA, 20 bp, Artificial Sequence
  Description of Artificial Sequence: Synthetic oligonucleotide
attagctgggtgtggttgct

SEQ ID NO: 8462 - DNA, 20 bp, Artificial Sequence
  Description of Artificial Sequence: Synthetic oligonucleotide
ttagctgggtgtggttgctc

SEQ ID NO: 8463 - DNA, 20 bp, Artificial Sequence
  Description of Artificial Sequence: Synthetic oligonucleotide
tagctgggtgtggttgctcg

SEQ ID NO: 8464 - DNA, 20 bp, Artificial Sequence
  Description of Artificial Sequence: Synthetic oligonucleotide
agctgggtgtggttgctcgc

SEQ ID NO: 8465 - DNA, 20 bp, Artificial Sequence
  Description of Artificial Sequence: Synthetic oligonucleotide
gctgggtgtggttgctcgca

SEQ ID NO: 8466 - DNA, 20 bp, Artificial Sequence
  Description of Artificial Sequence: Synthetic oligonucleotide
ctgggtgtggttgctcgcac

SEQ ID NO: 8467 - DNA, 20 bp, Artificial Sequence
  Description of Artificial Sequence: Synthetic oligonucleotide
tgggtgtggttgctcgcacc

SEQ ID NO: 8468 - DNA, 20 bp, Artificial Sequence
  Description of Artificial Sequence: Synthetic oligonucleotide
gggtgtggttgctcgcacct

SEQ ID NO: 8469 - DNA, 20 bp, Artificial Sequence
  Description of Artificial Sequence: Synthetic oligonucleotide
ggtgtggttgctcgcacctg

SEQ ID NO: 8470 - DNA, 20 bp, Artificial Sequence
  Description of Artificial Sequence: Synthetic oligonucleotide
gtgtggttgctcgcacctgt

SEQ ID NO: 8471 - DNA, 20 bp, Artificial Sequence
  Description of Artificial Sequence: Synthetic oligonucleotide
tgtggttgctcgcacctgta

SEQ ID NO: 8472 - DNA, 20 bp, Artificial Sequence
  Description of Artificial Sequence: Synthetic oligonucleotide
gtggttgctcgcacctgtag

SEQ ID NO: 8473 - DNA, 20 bp, Artificial Sequence
  Description of Artificial Sequence: Synthetic oligonucleotide
tggttgctcgcacctgtagt

SEQ ID NO: 8474 - DNA, 20 bp, Artificial Sequence
  Description of Artificial Sequence: Synthetic oligonucleotide
ggttgctcgcacctgtagtc

SEQ ID NO: 8475 - DNA, 20 bp, Artificial Sequence
  Description of Artificial Sequence: Synthetic oligonucleotide
gttgctcgcacctgtagtct

SEQ ID NO: 8476 - DNA, 20 bp, Artificial Sequence
  Description of Artificial Sequence: Synthetic oligonucleotide
ttgctcgcacctgtagtctc

SEQ ID NO: 8477 - DNA, 20 bp, Artificial Sequence
  Description of Artificial Sequence: Synthetic oligonucleotide
tgctcgcacctgtagtctca

SEQ ID NO: 8478 - DNA, 20 bp, Artificial Sequence
  Description of Artificial Sequence: Synthetic oligonucleotide
gctcgcacctgtagtctcag

SEQ ID NO: 8479 - DNA, 20 bp, Artificial Sequence
  Description of Artificial Sequence: Synthetic oligonucleotide
ctcgcacctgtagtctcagc

SEQ ID NO: 8480 - DNA, 20 bp, Artificial Sequence
  Description of Artificial Sequence: Synthetic oligonucleotide
tcgcacctgtagtctcagct

SEQ ID NO: 8481 - DNA, 20 bp, Artificial Sequence
  Description of Artificial Sequence: Synthetic oligonucleotide
cgcacctgtagtctcagcta

SEQ ID NO: 8482 - DNA, 20 bp, Artificial Sequence
  Description of Artificial Sequence: Synthetic oligonucleotide
gcacctgtagtctcagctac

SEQ ID NO: 8483 - DNA, 20 bp, Artificial Sequence
  Description of Artificial Sequence: Synthetic oligonucleotide
cacctgtagtctcagctact

SEQ ID NO: 8484 - DNA, 20 bp, Artificial Sequence
  Description of Artificial Sequence: Synthetic oligonucleotide
acctgtagtctcagctactg

SEQ ID NO: 8485 - DNA, 20 bp, Artificial Sequence
  Description of Artificial Sequence: Synthetic oligonucleotide
cctgtagtctcagctactgg

SEQ ID NO: 8486 - DNA, 20 bp, Artificial Sequence
  Description of Artificial Sequence: Synthetic oligonucleotide
ctgtagtctcagctactggg

SEQ ID NO: 8487 - DNA, 20 bp, Artificial Sequence
  Description of Artificial Sequence: Synthetic oligonucleotide
tgtagtctcagctactgggg

SEQ ID NO: 8488 - DNA, 20 bp, Artificial Sequence
  Description of Artificial Sequence: Synthetic oligonucleotide
gtagtctcagctactgggga

SEQ ID NO: 8489 - DNA, 20 bp, Artificial Sequence
  Description of Artificial Sequence: Synthetic oligonucleotide
tagtctcagctactggggag

SEQ ID NO: 8490 - DNA, 20 bp, Artificial Sequence
  Description of Artificial Sequence: Synthetic oligonucleotide
agtctcagctactggggagg

SEQ ID NO: 8491 - DNA, 20 bp, Artificial Sequence
  Description of Artificial Sequence: Synthetic oligonucleotide
gtctcagctactggggaggc

SEQ ID NO: 8492 - DNA, 20 bp, Artificial Sequence
  Description of Artificial Sequence: Synthetic oligonucleotide
tctcagctactggggaggct

SEQ ID NO: 8493 - DNA, 20 bp, Artificial Sequence
  Description of Artificial Sequence: Synthetic oligonucleotide
ctcagctactggggaggctg

SEQ ID NO: 8494 - DNA, 20 bp, Artificial Sequence
  Description of Artificial Sequence: Synthetic oligonucleotide
tcagctactggggaggctga

SEQ ID NO: 8495 - DNA, 20 bp, Artificial Sequence
  Description of Artificial Sequence: Synthetic oligonucleotide
cagctactggggaggctgac

SEQ ID NO: 8496 - DNA, 20 bp, Artificial Sequence
  Description of Artificial Sequence: Synthetic oligonucleotide
agctactggggaggctgacg

SEQ ID NO: 8497 - DNA, 20 bp, Artificial Sequence
  Description of Artificial Sequence: Synthetic oligonucleotide
gctactggggaggctgacgc

SEQ ID NO: 8498 - DNA, 20 bp, Artificial Sequence
  Description of Artificial Sequence: Synthetic oligonucleotide
ctactggggaggctgacgct

SEQ ID NO: 8499 - DNA, 20 bp, Artificial Sequence
  Description of Artificial Sequence: Synthetic oligonucleotide
tactggggaggctgacgctg

SEQ ID NO: 8500 - DNA, 20 bp, Artificial Sequence
  Description of Artificial Sequence: Synthetic oligonucleotide
actggggaggctgacgctgg

SEQ ID NO: 8501 - DNA, 20 bp, Artificial Sequence
  Description of Artificial Sequence: Synthetic oligonucleotide
ctggggaggctgacgctgga

SEQ ID NO: 8502 - DNA, 20 bp, Artificial Sequence
  Description of Artificial Sequence: Synthetic oligonucleotide
tggggaggctgacgctggag

SEQ ID NO: 8503 - DNA, 20 bp, Artificial Sequence
  Description of Artificial Sequence: Synthetic oligonucleotide
ggggaggctgacgctggaga

SEQ ID NO: 8504 - DNA, 20 bp, Artificial Sequence
  Description of Artificial Sequence: Synthetic oligonucleotide
gggaggctgacgctggagaa

SEQ ID NO: 8505 - DNA, 20 bp, Artificial Sequence
  Description of Artificial Sequence: Synthetic oligonucleotide
ggaggctgacgctggagaat

SEQ ID NO: 8506 - DNA, 20 bp, Artificial Sequence
  Description of Artificial Sequence: Synthetic oligonucleotide
gaggctgacgctggagaatt

SEQ ID NO: 8507 - DNA, 20 bp, Artificial Sequence
  Description of Artificial Sequence: Synthetic oligonucleotide
aggctgacgctggagaattg

SEQ ID NO: 8508 - DNA, 20 bp, Artificial Sequence
  Description of Artificial Sequence: Synthetic oligonucleotide
ggctgacgctggagaattgc

SEQ ID NO: 8509 - DNA, 20 bp, Artificial Sequence
  Description of Artificial Sequence: Synthetic oligonucleotide
gctgacgctggagaattgct

SEQ ID NO: 8510 - DNA, 20 bp, Artificial Sequence
  Description of Artificial Sequence: Synthetic oligonucleotide
ctgacgctggagaattgctt

SEQ ID NO: 8511 - DNA, 20 bp, Artificial Sequence
  Description of Artificial Sequence: Synthetic oligonucleotide
tgacgctggagaattgcttg

SEQ ID NO: 8512 - DNA, 20 bp, Artificial Sequence
  Description of Artificial Sequence: Synthetic oligonucleotide
gacgctggagaattgcttga

SEQ ID NO: 8513 - DNA, 20 bp, Artificial Sequence
  Description of Artificial Sequence: Synthetic oligonucleotide
acgctggagaattgcttgaa

SEQ ID NO: 8514 - DNA, 20 bp, Artificial Sequence
  Description of Artificial Sequence: Synthetic oligonucleotide
cgctggagaattgcttgaac

SEQ ID NO: 8515 - DNA, 20 bp, Artificial Sequence
  Description of Artificial Sequence: Synthetic oligonucleotide
gctggagaattgcttgaacc

SEQ ID NO: 8516 - DNA, 20 bp, Artificial Sequence
  Description of Artificial Sequence: Synthetic oligonucleotide
ctggagaattgcttgaaccc

SEQ ID NO: 8517 - DNA, 20 bp, Artificial Sequence
  Description of Artificial Sequence: Synthetic oligonucleotide
tggagaattgcttgaacccg

SEQ ID NO: 8518 - DNA, 20 bp, Artificial Sequence
  Description of Artificial Sequence: Synthetic oligonucleotide
ggagaattgcttgaacccgg

SEQ ID NO: 8519 - DNA, 20 bp, Artificial Sequence
  Description of Artificial Sequence: Synthetic oligonucleotide
gagaattgcttgaacccggg

SEQ ID NO: 8520 - DNA, 20 bp, Artificial Sequence
  Description of Artificial Sequence: Synthetic oligonucleotide
agaattgcttgaacccggga

SEQ ID NO: 8521 - DNA, 20 bp, Artificial Sequence
  Description of Artificial Sequence: Synthetic oligonucleotide
gaattgcttgaacccgggag

SEQ ID NO: 8522 - DNA, 20 bp, Artificial Sequence
  Description of Artificial Sequence: Synthetic oligonucleotide
aattgcttgaacccgggagg

SEQ ID NO: 8523 - DNA, 20 bp, Artificial Sequence
  Description of Artificial Sequence: Synthetic oligonucleotide
attgcttgaacccgggaggc

SEQ ID NO: 8524 - DNA, 20 bp, Artificial Sequence
  Description of Artificial Sequence: Synthetic oligonucleotide
ttgcttgaacccgggaggcg

SEQ ID NO: 8525 - DNA, 20 bp, Artificial Sequence
  Description of Artificial Sequence: Synthetic oligonucleotide
tgcttgaacccgggaggcgg

SEQ ID NO: 8526 - DNA, 20 bp, Artificial Sequence
  Description of Artificial Sequence: Synthetic oligonucleotide
gcttgaacccgggaggcgga

SEQ ID NO: 8527 - DNA, 20 bp, Artificial Sequence
  Description of Artificial Sequence: Synthetic oligonucleotide
cttgaacccgggaggcggag

SEQ ID NO: 8528 - DNA, 20 bp, Artificial Sequence
  Description of Artificial Sequence: Synthetic oligonucleotide
ttgaacccgggaggcggagg

SEQ ID NO: 8529 - DNA, 20 bp, Artificial Sequence
  Description of Artificial Sequence: Synthetic oligonucleotide
tgaacccgggaggcggaggt

SEQ ID NO: 8530 - DNA, 20 bp, Artificial Sequence
  Description of Artificial Sequence: Synthetic oligonucleotide
gaacccgggaggcggaggtt

SEQ ID NO: 8531 - DNA, 20 bp, Artificial Sequence
  Description of Artificial Sequence: Synthetic oligonucleotide
aacccgggaggcggaggttt

SEQ ID NO: 8532 - DNA, 20 bp, Artificial Sequence
  Description of Artificial Sequence: Synthetic oligonucleotide
acccgggaggcggaggtttc

SEQ ID NO: 8533 - DNA, 20 bp, Artificial Sequence
  Description of Artificial Sequence: Synthetic oligonucleotide
cccgggaggcggaggtttca

SEQ ID NO: 8534 - DNA, 20 bp, Artificial Sequence
  Description of Artificial Sequence: Synthetic oligonucleotide
ccgggaggcggaggtttcag

SEQ ID NO: 8535 - DNA, 20 bp, Artificial Sequence
  Description of Artificial Sequence: Synthetic oligonucleotide
cgggaggcggaggtttcagt

SEQ ID NO: 8536 - DNA, 20 bp, Artificial Sequence
  Description of Artificial Sequence: Synthetic oligonucleotide
gggaggcggaggtttcagtg

SEQ ID NO: 8537 - DNA, 20 bp, Artificial Sequence
  Description of Artificial Sequence: Synthetic oligonucleotide
ggaggcggaggtttcagtga

SEQ ID NO: 8538 - DNA, 20 bp, Artificial Sequence
  Description of Artificial Sequence: Synthetic oligonucleotide
gaggcggaggtttcagtgag

SEQ ID NO: 8539 - DNA, 20 bp, Artificial Sequence
  Description of Artificial Sequence: Synthetic oligonucleotide
aggcggaggtttcagtgagc

SEQ ID NO: 8540 - DNA, 20 bp, Artificial Sequence
  Description of Artificial Sequence: Synthetic oligonucleotide
ggcggaggtttcagtgagct

SEQ ID NO: 8541 - DNA, 20 bp, Artificial Sequence
  Description of Artificial Sequence: Synthetic oligonucleotide
gcggaggtttcagtgagctg

SEQ ID NO: 8542 - DNA, 20 bp, Artificial Sequence
  Description of Artificial Sequence: Synthetic oligonucleotide
cggaggtttcagtgagctga

SEQ ID NO: 8543 - DNA, 20 bp, Artificial Sequence
  Description of Artificial Sequence: Synthetic oligonucleotide
ggaggtttcagtgagctgag

SEQ ID NO: 8544 - DNA, 20 bp, Artificial Sequence
  Description of Artificial Sequence: Synthetic oligonucleotide
gaggtttcagtgagctgaga

SEQ ID NO: 8545 - DNA, 20 bp, Artificial Sequence
  Description of Artificial Sequence: Synthetic oligonucleotide
aggtttcagtgagctgagat

SEQ ID NO: 8546 - DNA, 20 bp, Artificial Sequence
  Description of Artificial Sequence: Synthetic oligonucleotide
ggtttcagtgagctgagatc

SEQ ID NO: 8547 - DNA, 20 bp, Artificial Sequence
  Description of Artificial Sequence: Synthetic oligonucleotide
gtttcagtgagctgagatcg

SEQ ID NO: 8548 - DNA, 20 bp, Artificial Sequence
  Description of Artificial Sequence: Synthetic oligonucleotide
tttcagtgagctgagatcgt

SEQ ID NO: 8549 - DNA, 20 bp, Artificial Sequence
  Description of Artificial Sequence: Synthetic oligonucleotide
ttcagtgagctgagatcgtg

SEQ ID NO: 8550 - DNA, 20 bp, Artificial Sequence
  Description of Artificial Sequence: Synthetic oligonucleotide
tcagtgagctgagatcgtgg

SEQ ID NO: 8551 - DNA, 20 bp, Artificial Sequence
  Description of Artificial Sequence: Synthetic oligonucleotide
cagtgagctgagatcgtggc

SEQ ID NO: 8552 - DNA, 20 bp, Artificial Sequence
  Description of Artificial Sequence: Synthetic oligonucleotide
agtgagctgagatcgtggca

SEQ ID NO: 8553 - DNA, 20 bp, Artificial Sequence
  Description of Artificial Sequence: Synthetic oligonucleotide
gtgagctgagatcgtggcat

SEQ ID NO: 8554 - DNA, 20 bp, Artificial Sequence
  Description of Artificial Sequence: Synthetic oligonucleotide
tgagctgagatcgtggcatt

SEQ ID NO: 8555 - DNA, 20 bp, Artificial Sequence
  Description of Artificial Sequence: Synthetic oligonucleotide
gagctgagatcgtggcattg

SEQ ID NO: 8556 - DNA, 20 bp, Artificial Sequence
  Description of Artificial Sequence: Synthetic oligonucleotide
agctgagatcgtggcattgc

SEQ ID NO: 8557 - DNA, 20 bp, Artificial Sequence
  Description of Artificial Sequence: Synthetic oligonucleotide
gctgagatcgtggcattgca

SEQ ID NO: 8558 - DNA, 20 bp, Artificial Sequence
  Description of Artificial Sequence: Synthetic oligonucleotide
ctgagatcgtggcattgcac

SEQ ID NO: 8559 - DNA, 20 bp, Artificial Sequence
  Description of Artificial Sequence: Synthetic oligonucleotide
tgagatcgtggcattgcact

SEQ ID NO: 8560 - DNA, 20 bp, Artificial Sequence
  Description of Artificial Sequence: Synthetic oligonucleotide
gagatcgtggcattgcactc

SEQ ID NO: 8561 - DNA, 20 bp, Artificial Sequence
  Description of Artificial Sequence: Synthetic oligonucleotide
agatcgtggcattgcactcc

SEQ ID NO: 8562 - DNA, 20 bp, Artificial Sequence
  Description of Artificial Sequence: Synthetic oligonucleotide
gatcgtggcattgcactcca

SEQ ID NO: 8563 - DNA, 20 bp, Artificial Sequence
  Description of Artificial Sequence: Synthetic oligonucleotide
atcgtggcattgcactccag

SEQ ID NO: 8564 - DNA, 20 bp, Artificial Sequence
  Description of Artificial Sequence: Synthetic oligonucleotide
tcgtggcattgcactccagc

SEQ ID NO: 8565 - DNA, 20 bp, Artificial Sequence
  Description of Artificial Sequence: Synthetic oligonucleotide
cgtggcattgcactccagct

SEQ ID NO: 8566 - DNA, 20 bp, Artificial Sequence
  Description of Artificial Sequence: Synthetic oligonucleotide
gtggcattgcactccagctc

SEQ ID NO: 8567 - DNA, 20 bp, Artificial Sequence
  Description of Artificial Sequence: Synthetic oligonucleotide
tggcattgcactccagctcc

SEQ ID NO: 8568 - DNA, 20 bp, Artificial Sequence
  Description of Artificial Sequence: Synthetic oligonucleotide
ggcattgcactccagctcca

SEQ ID NO: 8569 - DNA, 20 bp, Artificial Sequence
  Description of Artificial Sequence: Synthetic oligonucleotide
gcattgcactccagctccaa

SEQ ID NO: 8570 - DNA, 20 bp, Artificial Sequence
  Description of Artificial Sequence: Synthetic oligonucleotide
cattgcactccagctccaag

SEQ ID NO: 8571 - DNA, 20 bp, Artificial Sequence
  Description of Artificial Sequence: Synthetic oligonucleotide
attgcactccagctccaaga

SEQ ID NO: 8572 - DNA, 20 bp, Artificial Sequence
  Description of Artificial Sequence: Synthetic oligonucleotide
ttgcactccagctccaagag

SEQ ID NO: 8573 - DNA, 20 bp, Artificial Sequence
  Description of Artificial Sequence: Synthetic oligonucleotide
tgcactccagctccaagagc

SEQ ID NO: 8574 - DNA, 20 bp, Artificial Sequence
  Description of Artificial Sequence: Synthetic oligonucleotide
gcactccagctccaagagca

SEQ ID NO: 8575 - DNA, 20 bp, Artificial Sequence
  Description of Artificial Sequence: Synthetic oligonucleotide
cactccagctccaagagcaa

SEQ ID NO: 8576 - DNA, 20 bp, Artificial Sequence
  Description of Artificial Sequence: Synthetic oligonucleotide
actccagctccaagagcaaa

SEQ ID NO: 8577 - DNA, 20 bp, Artificial Sequence
  Description of Artificial Sequence: Synthetic oligonucleotide
ctccagctccaagagcaaaa

SEQ ID NO: 8578 - DNA, 20 bp, Artificial Sequence
  Description of Artificial Sequence: Synthetic oligonucleotide
tccagctccaagagcaaaac

SEQ ID NO: 8579 - DNA, 20 bp, Artificial Sequence
  Description of Artificial Sequence: Synthetic oligonucleotide
ccagctccaagagcaaaact

SEQ ID NO: 8580 - DNA, 20 bp, Artificial Sequence
  Description of Artificial Sequence: Synthetic oligonucleotide
cagctccaagagcaaaactc

SEQ ID NO: 8581 - DNA, 20 bp, Artificial Sequence
  Description of Artificial Sequence: Synthetic oligonucleotide
agctccaagagcaaaactcc

SEQ ID NO: 8582 - DNA, 20 bp, Artificial Sequence
  Description of Artificial Sequence: Synthetic oligonucleotide
gctccaagagcaaaactcca

SEQ ID NO: 8583 - DNA, 20 bp, Artificial Sequence
  Description of Artificial Sequence: Synthetic oligonucleotide
ctccaagagcaaaactccat

SEQ ID NO: 8584 - DNA, 20 bp, Artificial Sequence
  Description of Artificial Sequence: Synthetic oligonucleotide
tccaagagcaaaactccatc

SEQ ID NO: 8585 - DNA, 20 bp, Artificial Sequence
  Description of Artificial Sequence: Synthetic oligonucleotide
ccaagagcaaaactccatct

SEQ ID NO: 8586 - DNA, 20 bp, Artificial Sequence
  Description of Artificial Sequence: Synthetic oligonucleotide
caagagcaaaactccatctc

SEQ ID NO: 8587 - DNA, 20 bp, Artificial Sequence
  Description of Artificial Sequence: Synthetic oligonucleotide
aagagcaaaactccatctca

SEQ ID NO: 8588 - DNA, 20 bp, Artificial Sequence
  Description of Artificial Sequence: Synthetic oligonucleotide
agagcaaaactccatctcaa

SEQ ID NO: 8589 - DNA, 20 bp, Artificial Sequence
  Description of Artificial Sequence: Synthetic oligonucleotide
gagcaaaactccatctcaaa

SEQ ID NO: 8590 - DNA, 20 bp, Artificial Sequence
  Description of Artificial Sequence: Synthetic oligonucleotide
agcaaaactccatctcaaaa

SEQ ID NO: 8591 - DNA, 20 bp, Artificial Sequence
  Description of Artificial Sequence: Synthetic oligonucleotide
gcaaaactccatctcaaaaa

SEQ ID NO: 8592 - DNA, 20 bp, Artificial Sequence
  Description of Artificial Sequence: Synthetic oligonucleotide
caaaactccatctcaaaaaa

SEQ ID NO: 8593 - DNA, 20 bp, Artificial Sequence
  Description of Artificial Sequence: Synthetic oligonucleotide
aaaactccatctcaaaaaaa

SEQ ID NO: 8594 - DNA, 20 bp, Artificial Sequence
  Description of Artificial Sequence: Synthetic oligonucleotide
aaactccatctcaaaaaaaa

SEQ ID NO: 8595 - DNA, 20 bp, Artificial Sequence
  Description of Artificial Sequence: Synthetic oligonucleotide
aactccatctcaaaaaaaaa

SEQ ID NO: 8596 - DNA, 20 bp, Artificial Sequence
  Description of Artificial Sequence: Synthetic oligonucleotide
actccatctcaaaaaaaaaa

SEQ ID NO: 8597 - DNA, 20 bp, Artificial Sequence
  Description of Artificial Sequence: Synthetic oligonucleotide
ctccatctcaaaaaaaaaaa

SEQ ID NO: 8598 - DNA, 20 bp, Artificial Sequence
  Description of Artificial Sequence: Synthetic oligonucleotide
tccatctcaaaaaaaaaaaa

SEQ ID NO: 8599 - DNA, 20 bp, Artificial Sequence
  Description of Artificial Sequence: Synthetic oligonucleotide
ccatctcaaaaaaaaaaaaa

SEQ ID NO: 8600 - DNA, 20 bp, Artificial Sequence
  Description of Artificial Sequence: Synthetic oligonucleotide
catctcaaaaaaaaaaaaaa

SEQ ID NO: 8601 - DNA, 20 bp, Artificial Sequence
  Description of Artificial Sequence: Synthetic oligonucleotide
atctcaaaaaaaaaaaaaaa

SEQ ID NO: 8602 - DNA, 20 bp, Artificial Sequence
  Description of Artificial Sequence: Synthetic oligonucleotide
tctcaaaaaaaaaaaaaaaa

SEQ ID NO: 8603 - DNA, 20 bp, Artificial Sequence
  Description of Artificial Sequence: Synthetic oligonucleotide
ctcaaaaaaaaaaaaaaaaa

SEQ ID NO: 8604 - DNA, 20 bp, Artificial Sequence
  Description of Artificial Sequence: Synthetic oligonucleotide
tcaaaaaaaaaaaaaaaaaa

SEQ ID NO: 8605 - DNA, 20 bp, Artificial Sequence
  Description of Artificial Sequence: Synthetic oligonucleotide
caaaaaaaaaaaaaaaaaaa

SEQ ID NO: 8606 - DNA, 20 bp, Artificial Sequence
  Description of Artificial Sequence: Synthetic oligonucleotide
aaaaaaaaaaaaaaaaaaaa

SEQ ID NO: 8607 - DNA, 20 bp, Artificial Sequence
  Description of Artificial Sequence: Synthetic oligonucleotide
aaaaaaaaaaaaaaaaaaaa

SEQ ID NO: 8608 - DNA, 20 bp, Artificial Sequence
  Description of Artificial Sequence: Synthetic oligonucleotide
aaaaaaaaaaaaaaaaaaag

SEQ ID NO: 8609 - DNA, 20 bp, Artificial Sequence
  Description of Artificial Sequence: Synthetic oligonucleotide
aaaaaaaaaaaaaaaaaaga

SEQ ID NO: 8610 - DNA, 20 bp, Artificial Sequence
  Description of Artificial Sequence: Synthetic oligonucleotide
aaaaaaaaaaaaaaaaagac

SEQ ID NO: 8611 - DNA, 20 bp, Artificial Sequence
  Description of Artificial Sequence: Synthetic oligonucleotide
aaaaaaaaaaaaaaaagacc

SEQ ID NO: 8612 - DNA, 20 bp, Artificial Sequence
  Description of Artificial Sequence: Synthetic oligonucleotide
aaaaaaaaaaaaaaagacca

SEQ ID NO: 8613 - DNA, 20 bp, Artificial Sequence
  Description of Artificial Sequence: Synthetic oligonucleotide
aaaaaaaaaaaaaagaccag

SEQ ID NO: 8614 - DNA, 20 bp, Artificial Sequence
  Description of Artificial Sequence: Synthetic oligonucleotide
aaaaaaaaaaaaagaccagc

SEQ ID NO: 8615 - DNA, 20 bp, Artificial Sequence
  Description of Artificial Sequence: Synthetic oligonucleotide
aaaaaaaaaaaagaccagct

SEQ ID NO: 8616 - DNA, 20 bp, Artificial Sequence
  Description of Artificial Sequence: Synthetic oligonucleotide
aaaaaaaaaaagaccagctt

SEQ ID NO: 8617 - DNA, 20 bp, Artificial Sequence
  Description of Artificial Sequence: Synthetic oligonucleotide
aaaaaaaaaagaccagcttg

SEQ ID NO: 8618 - DNA, 20 bp, Artificial Sequence
  Description of Artificial Sequence: Synthetic oligonucleotide
aaaaaaaaagaccagcttgg

SEQ ID NO: 8619 - DNA, 20 bp, Artificial Sequence
  Description of Artificial Sequence: Synthetic oligonucleotide
aaaaaaaagaccagcttggg

SEQ ID NO: 8620 - DNA, 20 bp, Artificial Sequence
  Description of Artificial Sequence: Synthetic oligonucleotide
aaaaaaagaccagcttgggc

SEQ ID NO: 8621 - DNA, 20 bp, Artificial Sequence
  Description of Artificial Sequence: Synthetic oligonucleotide
aaaaaagaccagcttgggca

SEQ ID NO: 8622 - DNA, 20 bp, Artificial Sequence
  Description of Artificial Sequence: Synthetic oligonucleotide
aaaaagaccagcttgggcaa

SEQ ID NO: 8623 - DNA, 20 bp, Artificial Sequence
  Description of Artificial Sequence: Synthetic oligonucleotide
aaaagaccagcttgggcaac

SEQ ID NO: 8624 - DNA, 20 bp, Artificial Sequence
  Description of Artificial Sequence: Synthetic oligonucleotide
aaagaccagcttgggcaaca

SEQ ID NO: 8625 - DNA, 20 bp, Artificial Sequence
  Description of Artificial Sequence: Synthetic oligonucleotide
aagaccagcttgggcaacat

SEQ ID NO: 8626 - DNA, 20 bp, Artificial Sequence
  Description of Artificial Sequence: Synthetic oligonucleotide
agaccagcttgggcaacata

SEQ ID NO: 8627 - DNA, 20 bp, Artificial Sequence
  Description of Artificial Sequence: Synthetic oligonucleotide
gaccagcttgggcaacatag

SEQ ID NO: 8628 - DNA, 20 bp, Artificial Sequence
  Description of Artificial Sequence: Synthetic oligonucleotide
accagcttgggcaacatagc

SEQ ID NO: 8629 - DNA, 20 bp, Artificial Sequence
  Description of Artificial Sequence: Synthetic oligonucleotide
ccagcttgggcaacatagca

SEQ ID NO: 8630 - DNA, 20 bp, Artificial Sequence
  Description of Artificial Sequence: Synthetic oligonucleotide
cagcttgggcaacatagcaa

SEQ ID NO: 8631 - DNA, 20 bp, Artificial Sequence
  Description of Artificial Sequence: Synthetic oligonucleotide
agcttgggcaacatagcaag

SEQ ID NO: 8632 - DNA, 20 bp, Artificial Sequence
  Description of Artificial Sequence: Synthetic oligonucleotide
gcttgggcaacatagcaaga

SEQ ID NO: 8633 - DNA, 20 bp, Artificial Sequence
  Description of Artificial Sequence: Synthetic oligonucleotide
cttgggcaacatagcaagac

SEQ ID NO: 8634 - DNA, 20 bp, Artificial Sequence
  Description of Artificial Sequence: Synthetic oligonucleotide
ttgggcaacatagcaagacc

SEQ ID NO: 8635 - DNA, 20 bp, Artificial Sequence
  Description of Artificial Sequence: Synthetic oligonucleotide
tgggcaacatagcaagaccc

SEQ ID NO: 8636 - DNA, 20 bp, Artificial Sequence
  Description of Artificial Sequence: Synthetic oligonucleotide
gggcaacatagcaagaccct

SEQ ID NO: 8637 - DNA, 20 bp, Artificial Sequence
  Description of Artificial Sequence: Synthetic oligonucleotide
ggcaacatagcaagaccctg

SEQ ID NO: 8638 - DNA, 20 bp, Artificial Sequence
  Description of Artificial Sequence: Synthetic oligonucleotide
gcaacatagcaagaccctgc

SEQ ID NO: 8639 - DNA, 20 bp, Artificial Sequence
  Description of Artificial Sequence: Synthetic oligonucleotide
caacatagcaagaccctgcc

SEQ ID NO: 8640 - DNA, 20 bp, Artificial Sequence
  Description of Artificial Sequence: Synthetic oligonucleotide
aacatagcaagaccctgcct

SEQ ID NO: 8641 - DNA, 20 bp, Artificial Sequence
  Description of Artificial Sequence: Synthetic oligonucleotide
acatagcaagaccctgcctt

SEQ ID NO: 8642 - DNA, 20 bp, Artificial Sequence
  Description of Artificial Sequence: Synthetic oligonucleotide
catagcaagaccctgccttt

SEQ ID NO: 8643 - DNA, 20 bp, Artificial Sequence
  Description of Artificial Sequence: Synthetic oligonucleotide
atagcaagaccctgccttta

SEQ ID NO: 8644 - DNA, 20 bp, Artificial Sequence
  Description of Artificial Sequence: Synthetic oligonucleotide
tagcaagaccctgcctttaa

SEQ ID NO: 8645 - DNA, 20 bp, Artificial Sequence
  Description of Artificial Sequence: Synthetic oligonucleotide
agcaagaccctgcctttaat

SEQ ID NO: 8646 - DNA, 20 bp, Artificial Sequence
  Description of Artificial Sequence: Synthetic oligonucleotide
gcaagaccctgcctttaatt

SEQ ID NO: 8647 - DNA, 20 bp, Artificial Sequence
  Description of Artificial Sequence: Synthetic oligonucleotide
caagaccctgcctttaattt

SEQ ID NO: 8648 - DNA, 20 bp, Artificial Sequence
  Description of Artificial Sequence: Synthetic oligonucleotide
aagaccctgcctttaatttt

SEQ ID NO: 8649 - DNA, 20 bp, Artificial Sequence
  Description of Artificial Sequence: Synthetic oligonucleotide
agaccctgcctttaattttt

SEQ ID NO: 8650 - DNA, 20 bp, Artificial Sequence
  Description of Artificial Sequence: Synthetic oligonucleotide
gaccctgcctttaatttttt

SEQ ID NO: 8651 - DNA, 20 bp, Artificial Sequence
  Description of Artificial Sequence: Synthetic oligonucleotide
accctgcctttaattttttt

SEQ ID NO: 8652 - DNA, 20 bp, Artificial Sequence
  Description of Artificial Sequence: Synthetic oligonucleotide
ccctgcctttaatttttttg

SEQ ID NO: 8653 - DNA, 20 bp, Artificial Sequence
  Description of Artificial Sequence: Synthetic oligonucleotide
cctgcctttaatttttttgt

SEQ ID NO: 8654 - DNA, 20 bp, Artificial Sequence
  Description of Artificial Sequence: Synthetic oligonucleotide
ctgcctttaatttttttgtt

SEQ ID NO: 8655 - DNA, 20 bp, Artificial Sequence
  Description of Artificial Sequence: Synthetic oligonucleotide
tgcctttaatttttttgttt

SEQ ID NO: 8656 - DNA, 20 bp, Artificial Sequence
  Description of Artificial Sequence: Synthetic oligonucleotide
gcctttaatttttttgtttt

SEQ ID NO: 8657 - DNA, 20 bp, Artificial Sequence
  Description of Artificial Sequence: Synthetic oligonucleotide
cctttaatttttttgttttg

SEQ ID NO: 8658 - DNA, 20 bp, Artificial Sequence
  Description of Artificial Sequence: Synthetic oligonucleotide
ctttaatttttttgttttgt

SEQ ID NO: 8659 - DNA, 20 bp, Artificial Sequence
  Description of Artificial Sequence: Synthetic oligonucleotide
tttaatttttttgttttgtt

SEQ ID NO: 8660 - DNA, 20 bp, Artificial Sequence
  Description of Artificial Sequence: Synthetic oligonucleotide
ttaatttttttgttttgttt

SEQ ID NO: 8661 - DNA, 20 bp, Artificial Sequence
  Description of Artificial Sequence: Synthetic oligonucleotide
taatttttttgttttgtttt

SEQ ID NO: 8662 - DNA, 20 bp, Artificial Sequence
  Description of Artificial Sequence: Synthetic oligonucleotide
aatttttttgttttgttttg

SEQ ID NO: 8663 - DNA, 20 bp, Artificial Sequence
  Description of Artificial Sequence: Synthetic oligonucleotide
atttttttgttttgttttgt

SEQ ID NO: 8664 - DNA, 20 bp, Artificial Sequence
  Description of Artificial Sequence: Synthetic oligonucleotide
tttttttgttttgttttgtt

SEQ ID NO: 8665 - DNA, 20 bp, Artificial Sequence
  Description of Artificial Sequence: Synthetic oligonucleotide
ttttttgttttgttttgttt

SEQ ID NO: 8666 - DNA, 20 bp, Artificial Sequence
  Description of Artificial Sequence: Synthetic oligonucleotide
tttttgttttgttttgtttt

SEQ ID NO: 8667 - DNA, 20 bp, Artificial Sequence
  Description of Artificial Sequence: Synthetic oligonucleotide
ttttgttttgttttgttttc

SEQ ID NO: 8668 - DNA, 20 bp, Artificial Sequence
  Description of Artificial Sequence: Synthetic oligonucleotide
tttgttttgttttgttttca

SEQ ID NO: 8669 - DNA, 20 bp, Artificial Sequence
  Description of Artificial Sequence: Synthetic oligonucleotide
ttgttttgttttgttttcaa

SEQ ID NO: 8670 - DNA, 20 bp, Artificial Sequence
  Description of Artificial Sequence: Synthetic oligonucleotide
tgttttgttttgttttcaat

SEQ ID NO: 8671 - DNA, 20 bp, Artificial Sequence
  Description of Artificial Sequence: Synthetic oligonucleotide
gttttgttttgttttcaatt

SEQ ID NO: 8672 - DNA, 20 bp, Artificial Sequence
  Description of Artificial Sequence: Synthetic oligonucleotide
ttttgttttgttttcaattt

SEQ ID NO: 8673 - DNA, 20 bp, Artificial Sequence
  Description of Artificial Sequence: Synthetic oligonucleotide
tttgttttgttttcaattta

SEQ ID NO: 8674 - DNA, 20 bp, Artificial Sequence
  Description of Artificial Sequence: Synthetic oligonucleotide
ttgttttgttttcaatttaa

SEQ ID NO: 8675 - DNA, 20 bp, Artificial Sequence
  Description of Artificial Sequence: Synthetic oligonucleotide
tgttttgttttcaatttaaa

SEQ ID NO: 8676 - DNA, 20 bp, Artificial Sequence
  Description of Artificial Sequence: Synthetic oligonucleotide
gttttgttttcaatttaaag

SEQ ID NO: 8677 - DNA, 20 bp, Artificial Sequence
  Description of Artificial Sequence: Synthetic oligonucleotide
ttttgttttcaatttaaaga

SEQ ID NO: 8678 - DNA, 20 bp, Artificial Sequence
  Description of Artificial Sequence: Synthetic oligonucleotide
tttgttttcaatttaaagaa

SEQ ID NO: 8679 - DNA, 20 bp, Artificial Sequence
  Description of Artificial Sequence: Synthetic oligonucleotide
ttgttttcaatttaaagaaa

SEQ ID NO: 8680 - DNA, 20 bp, Artificial Sequence
  Description of Artificial Sequence: Synthetic oligonucleotide
tgttttcaatttaaagaaag

SEQ ID NO: 8681 - DNA, 20 bp, Artificial Sequence
  Description of Artificial Sequence: Synthetic oligonucleotide
gttttcaatttaaagaaaga

SEQ ID NO: 8682 - DNA, 20 bp, Artificial Sequence
  Description of Artificial Sequence: Synthetic oligonucleotide
ttttcaatttaaagaaagac

SEQ ID NO: 8683 - DNA, 20 bp, Artificial Sequence
  Description of Artificial Sequence: Synthetic oligonucleotide
tttcaatttaaagaaagaca

SEQ ID NO: 8684 - DNA, 20 bp, Artificial Sequence
  Description of Artificial Sequence: Synthetic oligonucleotide
ttcaatttaaagaaagacaa

SEQ ID NO: 8685 - DNA, 20 bp, Artificial Sequence
  Description of Artificial Sequence: Synthetic oligonucleotide
tcaatttaaagaaagacaac

SEQ ID NO: 8686 - DNA, 20 bp, Artificial Sequence
  Description of Artificial Sequence: Synthetic oligonucleotide
caatttaaagaaagacaaca

SEQ ID NO: 8687 - DNA, 20 bp, Artificial Sequence
  Description of Artificial Sequence: Synthetic oligonucleotide
aatttaaagaaagacaacag

SEQ ID NO: 8688 - DNA, 20 bp, Artificial Sequence
  Description of Artificial Sequence: Synthetic oligonucleotide
atttaaagaaagacaacagg

SEQ ID NO: 8689 - DNA, 20 bp, Artificial Sequence
  Description of Artificial Sequence: Synthetic oligonucleotide
tttaaagaaagacaacaggg

SEQ ID NO: 8690 - DNA, 20 bp, Artificial Sequence
  Description of Artificial Sequence: Synthetic oligonucleotide
ttaaagaaagacaacagggc

SEQ ID NO: 8691 - DNA, 20 bp, Artificial Sequence
  Description of Artificial Sequence: Synthetic oligonucleotide
taaagaaagacaacagggcc

SEQ ID NO: 8692 - DNA, 20 bp, Artificial Sequence
  Description of Artificial Sequence: Synthetic oligonucleotide
aaagaaagacaacagggcct

SEQ ID NO: 8693 - DNA, 20 bp, Artificial Sequence
  Description of Artificial Sequence: Synthetic oligonucleotide
aagaaagacaacagggccta

SEQ ID NO: 8694 - DNA, 20 bp, Artificial Sequence
  Description of Artificial Sequence: Synthetic oligonucleotide
agaaagacaacagggcctat

SEQ ID NO: 8695 - DNA, 20 bp, Artificial Sequence
  Description of Artificial Sequence: Synthetic oligonucleotide
gaaagacaacagggcctatg

SEQ ID NO: 8696 - DNA, 20 bp, Artificial Sequence
  Description of Artificial Sequence: Synthetic oligonucleotide
aaagacaacagggcctatgg

SEQ ID NO: 8697 - DNA, 20 bp, Artificial Sequence
  Description of Artificial Sequence: Synthetic oligonucleotide
aagacaacagggcctatggg

SEQ ID NO: 8698 - DNA, 20 bp, Artificial Sequence
  Description of Artificial Sequence: Synthetic oligonucleotide
agacaacagggcctatgggg

SEQ ID NO: 8699 - DNA, 20 bp, Artificial Sequence
  Description of Artificial Sequence: Synthetic oligonucleotide
gacaacagggcctatgggga

SEQ ID NO: 8700 - DNA, 20 bp, Artificial Sequence
  Description of Artificial Sequence: Synthetic oligonucleotide
acaacagggcctatggggag

SEQ ID NO: 8701 - DNA, 20 bp, Artificial Sequence
  Description of Artificial Sequence: Synthetic oligonucleotide
caacagggcctatggggaga

SEQ ID NO: 8702 - DNA, 20 bp, Artificial Sequence
  Description of Artificial Sequence: Synthetic oligonucleotide
aacagggcctatggggagag

SEQ ID NO: 8703 - DNA, 20 bp, Artificial Sequence
  Description of Artificial Sequence: Synthetic oligonucleotide
acagggcctatggggagagg

SEQ ID NO: 8704 - DNA, 20 bp, Artificial Sequence
  Description of Artificial Sequence: Synthetic oligonucleotide
cagggcctatggggagaggg

SEQ ID NO: 8705 - DNA, 20 bp, Artificial Sequence
  Description of Artificial Sequence: Synthetic oligonucleotide
agggcctatggggagagggg

SEQ ID NO: 8706 - DNA, 20 bp, Artificial Sequence
  Description of Artificial Sequence: Synthetic oligonucleotide
gggcctatggggagaggggc

SEQ ID NO: 8707 - DNA, 20 bp, Artificial Sequence
  Description of Artificial Sequence: Synthetic oligonucleotide
ggcctatggggagaggggcc

SEQ ID NO: 8708 - DNA, 20 bp, Artificial Sequence
  Description of Artificial Sequence: Synthetic oligonucleotide
gcctatggggagaggggccc

SEQ ID NO: 8709 - DNA, 20 bp, Artificial Sequence
  Description of Artificial Sequence: Synthetic oligonucleotide
cctatggggagaggggcccc

SEQ ID NO: 8710 - DNA, 20 bp, Artificial Sequence
  Description of Artificial Sequence: Synthetic oligonucleotide
ctatggggagaggggcccct

SEQ ID NO: 8711 - DNA, 20 bp, Artificial Sequence
  Description of Artificial Sequence: Synthetic oligonucleotide
tatggggagaggggcccctg

SEQ ID NO: 8712 - DNA, 20 bp, Artificial Sequence
  Description of Artificial Sequence: Synthetic oligonucleotide
atggggagaggggcccctgg

SEQ ID NO: 8713 - DNA, 20 bp, Artificial Sequence
  Description of Artificial Sequence: Synthetic oligonucleotide
tggggagaggggcccctggt

SEQ ID NO: 8714 - DNA, 20 bp, Artificial Sequence
  Description of Artificial Sequence: Synthetic oligonucleotide
ggggagaggggcccctggtg

SEQ ID NO: 8715 - DNA, 20 bp, Artificial Sequence
  Description of Artificial Sequence: Synthetic oligonucleotide
gggagaggggcccctggtgg

SEQ ID NO: 8716 - DNA, 20 bp, Artificial Sequence
  Description of Artificial Sequence: Synthetic oligonucleotide
ggagaggggcccctggtgga

SEQ ID NO: 8717 - DNA, 20 bp, Artificial Sequence
  Description of Artificial Sequence: Synthetic oligonucleotide
gagaggggcccctggtggac

SEQ ID NO: 8718 - DNA, 20 bp, Artificial Sequence
  Description of Artificial Sequence: Synthetic oligonucleotide
agaggggcccctggtggact

SEQ ID NO: 8719 - DNA, 20 bp, Artificial Sequence
  Description of Artificial Sequence: Synthetic oligonucleotide
gaggggcccctggtggacta

SEQ ID NO: 8720 - DNA, 20 bp, Artificial Sequence
  Description of Artificial Sequence: Synthetic oligonucleotide
aggggcccctggtggactaa

SEQ ID NO: 8721 - DNA, 20 bp, Artificial Sequence
  Description of Artificial Sequence: Synthetic oligonucleotide
ggggcccctggtggactaac

SEQ ID NO: 8722 - DNA, 20 bp, Artificial Sequence
  Description of Artificial Sequence: Synthetic oligonucleotide
gggcccctggtggactaaca

SEQ ID NO: 8723 - DNA, 20 bp, Artificial Sequence
  Description of Artificial Sequence: Synthetic oligonucleotide
ggcccctggtggactaacac

SEQ ID NO: 8724 - DNA, 20 bp, Artificial Sequence
  Description of Artificial Sequence: Synthetic oligonucleotide
gcccctggtggactaacaca

SEQ ID NO: 8725 - DNA, 20 bp, Artificial Sequence
  Description of Artificial Sequence: Synthetic oligonucleotide
cccctggtggactaacacac

SEQ ID NO: 8726 - DNA, 20 bp, Artificial Sequence
  Description of Artificial Sequence: Synthetic oligonucleotide
ccctggtggactaacacacc

SEQ ID NO: 8727 - DNA, 20 bp, Artificial Sequence
  Description of Artificial Sequence: Synthetic oligonucleotide
cctggtggactaacacaccc

SEQ ID NO: 8728 - DNA, 20 bp, Artificial Sequence
  Description of Artificial Sequence: Synthetic oligonucleotide
ctggtggactaacacaccct

SEQ ID NO: 8729 - DNA, 20 bp, Artificial Sequence
  Description of Artificial Sequence: Synthetic oligonucleotide
tggtggactaacacacccta

SEQ ID NO: 8730 - DNA, 20 bp, Artificial Sequence
  Description of Artificial Sequence: Synthetic oligonucleotide
ggtggactaacacaccctac

SEQ ID NO: 8731 - DNA, 20 bp, Artificial Sequence
  Description of Artificial Sequence: Synthetic oligonucleotide
gtggactaacacaccctacc

SEQ ID NO: 8732 - DNA, 20 bp, Artificial Sequence
  Description of Artificial Sequence: Synthetic oligonucleotide
tggactaacacaccctacct

SEQ ID NO: 8733 - DNA, 20 bp, Artificial Sequence
  Description of Artificial Sequence: Synthetic oligonucleotide
ggactaacacaccctacctg

SEQ ID NO: 8734 - DNA, 20 bp, Artificial Sequence
  Description of Artificial Sequence: Synthetic oligonucleotide
gactaacacaccctacctga

SEQ ID NO: 8735 - DNA, 20 bp, Artificial Sequence
  Description of Artificial Sequence: Synthetic oligonucleotide
actaacacaccctacctgag

SEQ ID NO: 8736 - DNA, 20 bp, Artificial Sequence
  Description of Artificial Sequence: Synthetic oligonucleotide
ctaacacaccctacctgagg

SEQ ID NO: 8737 - DNA, 20 bp, Artificial Sequence
  Description of Artificial Sequence: Synthetic oligonucleotide
taacacaccctacctgaggt

SEQ ID NO: 8738 - DNA, 20 bp, Artificial Sequence
  Description of Artificial Sequence: Synthetic oligonucleotide
aacacaccctacctgaggtc

SEQ ID NO: 8739 - DNA, 20 bp, Artificial Sequence
  Description of Artificial Sequence: Synthetic oligonucleotide
acacaccctacctgaggtca

SEQ ID NO: 8740 - DNA, 20 bp, Artificial Sequence
  Description of Artificial Sequence: Synthetic oligonucleotide
cacaccctacctgaggtcat

SEQ ID NO: 8741 - DNA, 20 bp, Artificial Sequence
  Description of Artificial Sequence: Synthetic oligonucleotide
acaccctacctgaggtcatc

SEQ ID NO: 8742 - DNA, 20 bp, Artificial Sequence
  Description of Artificial Sequence: Synthetic oligonucleotide
caccctacctgaggtcatct

SEQ ID NO: 8743 - DNA, 20 bp, Artificial Sequence
  Description of Artificial Sequence: Synthetic oligonucleotide
accctacctgaggtcatctt

SEQ ID NO: 8744 - DNA, 20 bp, Artificial Sequence
  Description of Artificial Sequence: Synthetic oligonucleotide
ccctacctgaggtcatcttg

SEQ ID NO: 8745 - DNA, 20 bp, Artificial Sequence
  Description of Artificial Sequence: Synthetic oligonucleotide
cctacctgaggtcatcttgc

SEQ ID NO: 8746 - DNA, 20 bp, Artificial Sequence
  Description of Artificial Sequence: Synthetic oligonucleotide
ctacctgaggtcatcttgca

SEQ ID NO: 8747 - DNA, 20 bp, Artificial Sequence
  Description of Artificial Sequence: Synthetic oligonucleotide
tacctgaggtcatcttgcag

SEQ ID NO: 8748 - DNA, 20 bp, Artificial Sequence
  Description of Artificial Sequence: Synthetic oligonucleotide
acctgaggtcatcttgcagt

SEQ ID NO: 8749 - DNA, 20 bp, Artificial Sequence
  Description of Artificial Sequence: Synthetic oligonucleotide
cctgaggtcatcttgcagtt

SEQ ID NO: 8750 - DNA, 20 bp, Artificial Sequence
  Description of Artificial Sequence: Synthetic oligonucleotide
ctgaggtcatcttgcagttc

SEQ ID NO: 8751 - DNA, 20 bp, Artificial Sequence
  Description of Artificial Sequence: Synthetic oligonucleotide
tgaggtcatcttgcagttca

SEQ ID NO: 8752 - DNA, 20 bp, Artificial Sequence
  Description of Artificial Sequence: Synthetic oligonucleotide
gaggtcatcttgcagttcac

SEQ ID NO: 8753 - DNA, 20 bp, Artificial Sequence
  Description of Artificial Sequence: Synthetic oligonucleotide
aggtcatcttgcagttcacc

SEQ ID NO: 8754 - DNA, 20 bp, Artificial Sequence
  Description of Artificial Sequence: Synthetic oligonucleotide
ggtcatcttgcagttcacca

SEQ ID NO: 8755 - DNA, 20 bp, Artificial Sequence
  Description of Artificial Sequence: Synthetic oligonucleotide
gtcatcttgcagttcaccaa

SEQ ID NO: 8756 - DNA, 20 bp, Artificial Sequence
  Description of Artificial Sequence: Synthetic oligonucleotide
tcatcttgcagttcaccaaa

SEQ ID NO: 8757 - DNA, 20 bp, Artificial Sequence
  Description of Artificial Sequence: Synthetic oligonucleotide
catcttgcagttcaccaaaa

SEQ ID NO: 8758 - DNA, 20 bp, Artificial Sequence
  Description of Artificial Sequence: Synthetic oligonucleotide
atcttgcagttcaccaaaaa

SEQ ID NO: 8759 - DNA, 20 bp, Artificial Sequence
  Description of Artificial Sequence: Synthetic oligonucleotide
tcttgcagttcaccaaaaat

SEQ ID NO: 8760 - DNA, 20 bp, Artificial Sequence
  Description of Artificial Sequence: Synthetic oligonucleotide
cttgcagttcaccaaaaatg

SEQ ID NO: 8761 - DNA, 20 bp, Artificial Sequence
  Description of Artificial Sequence: Synthetic oligonucleotide
ttgcagttcaccaaaaatgg

SEQ ID NO: 8762 - DNA, 20 bp, Artificial Sequence
  Description of Artificial Sequence: Synthetic oligonucleotide
tgcagttcaccaaaaatggc

SEQ ID NO: 8763 - DNA, 20 bp, Artificial Sequence
  Description of Artificial Sequence: Synthetic oligonucleotide
gcagttcaccaaaaatggcg

SEQ ID NO: 8764 - DNA, 20 bp, Artificial Sequence
  Description of Artificial Sequence: Synthetic oligonucleotide
cagttcaccaaaaatggcgg

SEQ ID NO: 8765 - DNA, 20 bp, Artificial Sequence
  Description of Artificial Sequence: Synthetic oligonucleotide
agttcaccaaaaatggcgga

SEQ ID NO: 8766 - DNA, 20 bp, Artificial Sequence
  Description of Artificial Sequence: Synthetic oligonucleotide
gttcaccaaaaatggcggag

SEQ ID NO: 8767 - DNA, 20 bp, Artificial Sequence
  Description of Artificial Sequence: Synthetic oligonucleotide
ttcaccaaaaatggcggaga

SEQ ID NO: 8768 - DNA, 20 bp, Artificial Sequence
  Description of Artificial Sequence: Synthetic oligonucleotide
tcaccaaaaatggcggagac

SEQ ID NO: 8769 - DNA, 20 bp, Artificial Sequence
  Description of Artificial Sequence: Synthetic oligonucleotide
caccaaaaatggcggagacc

SEQ ID NO: 8770 - DNA, 20 bp, Artificial Sequence
  Description of Artificial Sequence: Synthetic oligonucleotide
accaaaaatggcggagaccc

SEQ ID NO: 8771 - DNA, 20 bp, Artificial Sequence
  Description of Artificial Sequence: Synthetic oligonucleotide
ccaaaaatggcggagacccc

SEQ ID NO: 8772 - DNA, 20 bp, Artificial Sequence
  Description of Artificial Sequence: Synthetic oligonucleotide
caaaaatggcggagacccct

SEQ ID NO: 8773 - DNA, 20 bp, Artificial Sequence
  Description of Artificial Sequence: Synthetic oligonucleotide
aaaaatggcggagacccctg

SEQ ID NO: 8774 - DNA, 20 bp, Artificial Sequence
  Description of Artificial Sequence: Synthetic oligonucleotide
aaaatggcggagacccctga

SEQ ID NO: 8775 - DNA, 20 bp, Artificial Sequence
  Description of Artificial Sequence: Synthetic oligonucleotide
aaatggcggagacccctgag

SEQ ID NO: 8776 - DNA, 20 bp, Artificial Sequence
  Description of Artificial Sequence: Synthetic oligonucleotide
aatggcggagacccctgagg

SEQ ID NO: 8777 - DNA, 20 bp, Artificial Sequence
  Description of Artificial Sequence: Synthetic oligonucleotide
atggcggagacccctgaggc

SEQ ID NO: 8778 - DNA, 20 bp, Artificial Sequence
  Description of Artificial Sequence: Synthetic oligonucleotide
tggcggagacccctgaggct

SEQ ID NO: 8779 - DNA, 20 bp, Artificial Sequence
  Description of Artificial Sequence: Synthetic oligonucleotide
ggcggagacccctgaggctg

SEQ ID NO: 8780 - DNA, 20 bp, Artificial Sequence
  Description of Artificial Sequence: Synthetic oligonucleotide
gcggagacccctgaggctgg

SEQ ID NO: 8781 - DNA, 20 bp, Artificial Sequence
  Description of Artificial Sequence: Synthetic oligonucleotide
cggagacccctgaggctgga

SEQ ID NO: 8782 - DNA, 20 bp, Artificial Sequence
  Description of Artificial Sequence: Synthetic oligonucleotide
ggagacccctgaggctggat

SEQ ID NO: 8783 - DNA, 20 bp, Artificial Sequence
  Description of Artificial Sequence: Synthetic oligonucleotide
gagacccctgaggctggatt

SEQ ID NO: 8784 - DNA, 20 bp, Artificial Sequence
  Description of Artificial Sequence: Synthetic oligonucleotide
agacccctgaggctggattt

SEQ ID NO: 8785 - DNA, 20 bp, Artificial Sequence
  Description of Artificial Sequence: Synthetic oligonucleotide
gacccctgaggctggatttc

SEQ ID NO: 8786 - DNA, 20 bp, Artificial Sequence
  Description of Artificial Sequence: Synthetic oligonucleotide
acccctgaggctggatttca

SEQ ID NO: 8787 - DNA, 20 bp, Artificial Sequence
  Description of Artificial Sequence: Synthetic oligonucleotide
cccctgaggctggatttcaa

SEQ ID NO: 8788 - DNA, 20 bp, Artificial Sequence
  Description of Artificial Sequence: Synthetic oligonucleotide
ccctgaggctggatttcaaa

SEQ ID NO: 8789 - DNA, 20 bp, Artificial Sequence
  Description of Artificial Sequence: Synthetic oligonucleotide
cctgaggctggatttcaaat

SEQ ID NO: 8790 - DNA, 20 bp, Artificial Sequence
  Description of Artificial Sequence: Synthetic oligonucleotide
ctgaggctggatttcaaata

SEQ ID NO: 8791 - DNA, 20 bp, Artificial Sequence
  Description of Artificial Sequence: Synthetic oligonucleotide
tgaggctggatttcaaatag

SEQ ID NO: 8792 - DNA, 20 bp, Artificial Sequence
  Description of Artificial Sequence: Synthetic oligonucleotide
gaggctggatttcaaatagt

SEQ ID NO: 8793 - DNA, 20 bp, Artificial Sequence
  Description of Artificial Sequence: Synthetic oligonucleotide
aggctggatttcaaatagtc

SEQ ID NO: 8794 - DNA, 20 bp, Artificial Sequence
  Description of Artificial Sequence: Synthetic oligonucleotide
ggctggatttcaaatagtcc

SEQ ID NO: 8795 - DNA, 20 bp, Artificial Sequence
  Description of Artificial Sequence: Synthetic oligonucleotide
gctggatttcaaatagtcca

SEQ ID NO: 8796 - DNA, 20 bp, Artificial Sequence
  Description of Artificial Sequence: Synthetic oligonucleotide
ctggatttcaaatagtccac

SEQ ID NO: 8797 - DNA, 20 bp, Artificial Sequence
  Description of Artificial Sequence: Synthetic oligonucleotide
tggatttcaaatagtccact

SEQ ID NO: 8798 - DNA, 20 bp, Artificial Sequence
  Description of Artificial Sequence: Synthetic oligonucleotide
ggatttcaaatagtccactc

SEQ ID NO: 8799 - DNA, 20 bp, Artificial Sequence
  Description of Artificial Sequence: Synthetic oligonucleotide
gatttcaaatagtccactct

SEQ ID NO: 8800 - DNA, 20 bp, Artificial Sequence
  Description of Artificial Sequence: Synthetic oligonucleotide
atttcaaatagtccactctg

SEQ ID NO: 8801 - DNA, 20 bp, Artificial Sequence
  Description of Artificial Sequence: Synthetic oligonucleotide
tttcaaatagtccactctgc

SEQ ID NO: 8802 - DNA, 20 bp, Artificial Sequence
  Description of Artificial Sequence: Synthetic oligonucleotide
ttcaaatagtccactctgcc

SEQ ID NO: 8803 - DNA, 20 bp, Artificial Sequence
  Description of Artificial Sequence: Synthetic oligonucleotide
tcaaatagtccactctgcct

SEQ ID NO: 8804 - DNA, 20 bp, Artificial Sequence
  Description of Artificial Sequence: Synthetic oligonucleotide
caaatagtccactctgcctc

SEQ ID NO: 8805 - DNA, 20 bp, Artificial Sequence
  Description of Artificial Sequence: Synthetic oligonucleotide
aaatagtccactctgcctct

SEQ ID NO: 8806 - DNA, 20 bp, Artificial Sequence
  Description of Artificial Sequence: Synthetic oligonucleotide
aatagtccactctgcctctc

SEQ ID NO: 8807 - DNA, 20 bp, Artificial Sequence
  Description of Artificial Sequence: Synthetic oligonucleotide
atagtccactctgcctctcc

SEQ ID NO: 8808 - DNA, 20 bp, Artificial Sequence
  Description of Artificial Sequence: Synthetic oligonucleotide
tagtccactctgcctctccc

SEQ ID NO: 8809 - DNA, 20 bp, Artificial Sequence
  Description of Artificial Sequence: Synthetic oligonucleotide
agtccactctgcctctcccc

SEQ ID NO: 8810 - DNA, 20 bp, Artificial Sequence
  Description of Artificial Sequence: Synthetic oligonucleotide
gtccactctgcctctcccca

SEQ ID NO: 8811 - DNA, 20 bp, Artificial Sequence
  Description of Artificial Sequence: Synthetic oligonucleotide
tccactctgcctctccccaa

SEQ ID NO: 8812 - DNA, 20 bp, Artificial Sequence
  Description of Artificial Sequence: Synthetic oligonucleotide
ccactctgcctctccccaac

SEQ ID NO: 8813 - DNA, 20 bp, Artificial Sequence
  Description of Artificial Sequence: Synthetic oligonucleotide
cactctgcctctccccaacc

SEQ ID NO: 8814 - DNA, 20 bp, Artificial Sequence
  Description of Artificial Sequence: Synthetic oligonucleotide
actctgcctctccccaacct

SEQ ID NO: 8815 - DNA, 20 bp, Artificial Sequence
  Description of Artificial Sequence: Synthetic oligonucleotide
ctctgcctctccccaacctg

SEQ ID NO: 8816 - DNA, 20 bp, Artificial Sequence
  Description of Artificial Sequence: Synthetic oligonucleotide
tctgcctctccccaacctgg

SEQ ID NO: 8817 - DNA, 20 bp, Artificial Sequence
  Description of Artificial Sequence: Synthetic oligonucleotide
ctgcctctccccaacctgga

SEQ ID NO: 8818 - DNA, 20 bp, Artificial Sequence
  Description of Artificial Sequence: Synthetic oligonucleotide
tgcctctccccaacctggaa

SEQ ID NO: 8819 - DNA, 20 bp, Artificial Sequence
  Description of Artificial Sequence: Synthetic oligonucleotide
gcctctccccaacctggaac

SEQ ID NO: 8820 - DNA, 20 bp, Artificial Sequence
  Description of Artificial Sequence: Synthetic oligonucleotide
cctctccccaacctggaaca

SEQ ID NO: 8821 - DNA, 20 bp, Artificial Sequence
  Description of Artificial Sequence: Synthetic oligonucleotide
ctctccccaacctggaacag

SEQ ID NO: 8822 - DNA, 20 bp, Artificial Sequence
  Description of Artificial Sequence: Synthetic oligonucleotide
tctccccaacctggaacagc

SEQ ID NO: 8823 - DNA, 20 bp, Artificial Sequence
  Description of Artificial Sequence: Synthetic oligonucleotide
ctccccaacctggaacagct

SEQ ID NO: 8824 - DNA, 20 bp, Artificial Sequence
  Description of Artificial Sequence: Synthetic oligonucleotide
tccccaacctggaacagctc

SEQ ID NO: 8825 - DNA, 20 bp, Artificial Sequence
  Description of Artificial Sequence: Synthetic oligonucleotide
ccccaacctggaacagctcc

SEQ ID NO: 8826 - DNA, 20 bp, Artificial Sequence
  Description of Artificial Sequence: Synthetic oligonucleotide
cccaacctggaacagctcct

SEQ ID NO: 8827 - DNA, 20 bp, Artificial Sequence
  Description of Artificial Sequence: Synthetic oligonucleotide
ccaacctggaacagctcctg

SEQ ID NO: 8828 - DNA, 20 bp, Artificial Sequence
  Description of Artificial Sequence: Synthetic oligonucleotide
caacctggaacagctcctgg

SEQ ID NO: 8829 - DNA, 20 bp, Artificial Sequence
  Description of Artificial Sequence: Synthetic oligonucleotide
aacctggaacagctcctggc

SEQ ID NO: 8830 - DNA, 20 bp, Artificial Sequence
  Description of Artificial Sequence: Synthetic oligonucleotide
acctggaacagctcctggca

SEQ ID NO: 8831 - DNA, 20 bp, Artificial Sequence
  Description of Artificial Sequence: Synthetic oligonucleotide
cctggaacagctcctggcaa

SEQ ID NO: 8832 - DNA, 20 bp, Artificial Sequence
  Description of Artificial Sequence: Synthetic oligonucleotide
ctggaacagctcctggcaat

SEQ ID NO: 8833 - DNA, 20 bp, Artificial Sequence
  Description of Artificial Sequence: Synthetic oligonucleotide
tggaacagctcctggcaatc

SEQ ID NO: 8834 - DNA, 20 bp, Artificial Sequence
  Description of Artificial Sequence: Synthetic oligonucleotide
ggaacagctcctggcaatcc

SEQ ID NO: 8835 - DNA, 20 bp, Artificial Sequence
  Description of Artificial Sequence: Synthetic oligonucleotide
gaacagctcctggcaatccc

SEQ ID NO: 8836 - DNA, 20 bp, Artificial Sequence
  Description of Artificial Sequence: Synthetic oligonucleotide
aacagctcctggcaatccct

SEQ ID NO: 8837 - DNA, 20 bp, Artificial Sequence
  Description of Artificial Sequence: Synthetic oligonucleotide
acagctcctggcaatccctg

SEQ ID NO: 8838 - DNA, 20 bp, Artificial Sequence
  Description of Artificial Sequence: Synthetic oligonucleotide
cagctcctggcaatccctgg

SEQ ID NO: 8839 - DNA, 20 bp, Artificial Sequence
  Description of Artificial Sequence: Synthetic oligonucleotide
agctcctggcaatccctggg

SEQ ID NO: 8840 - DNA, 20 bp, Artificial Sequence
  Description of Artificial Sequence: Synthetic oligonucleotide
gctcctggcaatccctgggc

SEQ ID NO: 8841 - DNA, 20 bp, Artificial Sequence
  Description of Artificial Sequence: Synthetic oligonucleotide
ctcctggcaatccctgggca

SEQ ID NO: 8842 - DNA, 20 bp, Artificial Sequence
  Description of Artificial Sequence: Synthetic oligonucleotide
tcctggcaatccctgggcag

SEQ ID NO: 8843 - DNA, 20 bp, Artificial Sequence
  Description of Artificial Sequence: Synthetic oligonucleotide
cctggcaatccctgggcagc

SEQ ID NO: 8844 - DNA, 20 bp, Artificial Sequence
  Description of Artificial Sequence: Synthetic oligonucleotide
ctggcaatccctgggcagcc

SEQ ID NO: 8845 - DNA, 20 bp, Artificial Sequence
  Description of Artificial Sequence: Synthetic oligonucleotide
tggcaatccctgggcagccc

SEQ ID NO: 8846 - DNA, 20 bp, Artificial Sequence
  Description of Artificial Sequence: Synthetic oligonucleotide
ggcaatccctgggcagccct

SEQ ID NO: 8847 - DNA, 20 bp, Artificial Sequence
  Description of Artificial Sequence: Synthetic oligonucleotide
gcaatccctgggcagccctg

SEQ ID NO: 8848 - DNA, 20 bp, Artificial Sequence
  Description of Artificial Sequence: Synthetic oligonucleotide
caatccctgggcagccctga

SEQ ID NO: 8849 - DNA, 20 bp, Artificial Sequence
  Description of Artificial Sequence: Synthetic oligonucleotide
aatccctgggcagccctgaa

SEQ ID NO: 8850 - DNA, 20 bp, Artificial Sequence
  Description of Artificial Sequence: Synthetic oligonucleotide
atccctgggcagccctgaag

SEQ ID NO: 8851 - DNA, 20 bp, Artificial Sequence
  Description of Artificial Sequence: Synthetic oligonucleotide
tccctgggcagccctgaagg

SEQ ID NO: 8852 - DNA, 20 bp, Artificial Sequence
  Description of Artificial Sequence: Synthetic oligonucleotide
ccctgggcagccctgaaggg

SEQ ID NO: 8853 - DNA, 20 bp, Artificial Sequence
  Description of Artificial Sequence: Synthetic oligonucleotide
cctgggcagccctgaaggga

SEQ ID NO: 8854 - DNA, 20 bp, Artificial Sequence
  Description of Artificial Sequence: Synthetic oligonucleotide
ctgggcagccctgaagggag

SEQ ID NO: 8855 - DNA, 20 bp, Artificial Sequence
  Description of Artificial Sequence: Synthetic oligonucleotide
tgggcagccctgaagggaga

SEQ ID NO: 8856 - DNA, 20 bp, Artificial Sequence
  Description of Artificial Sequence: Synthetic oligonucleotide
gggcagccctgaagggagat

SEQ ID NO: 8857 - DNA, 20 bp, Artificial Sequence
  Description of Artificial Sequence: Synthetic oligonucleotide
ggcagccctgaagggagata

SEQ ID NO: 8858 - DNA, 20 bp, Artificial Sequence
  Description of Artificial Sequence: Synthetic oligonucleotide
gcagccctgaagggagataa

SEQ ID NO: 8859 - DNA, 20 bp, Artificial Sequence
  Description of Artificial Sequence: Synthetic oligonucleotide
cagccctgaagggagataaa

SEQ ID NO: 8860 - DNA, 20 bp, Artificial Sequence
  Description of Artificial Sequence: Synthetic oligonucleotide
agccctgaagggagataaag

SEQ ID NO: 8861 - DNA, 20 bp, Artificial Sequence
  Description of Artificial Sequence: Synthetic oligonucleotide
gccctgaagggagataaagt

SEQ ID NO: 8862 - DNA, 20 bp, Artificial Sequence
  Description of Artificial Sequence: Synthetic oligonucleotide
ccctgaagggagataaagtg

SEQ ID NO: 8863 - DNA, 20 bp, Artificial Sequence
  Description of Artificial Sequence: Synthetic oligonucleotide
cctgaagggagataaagtgg

SEQ ID NO: 8864 - DNA, 20 bp, Artificial Sequence
  Description of Artificial Sequence: Synthetic oligonucleotide
ctgaagggagataaagtgga

SEQ ID NO: 8865 - DNA, 20 bp, Artificial Sequence
  Description of Artificial Sequence: Synthetic oligonucleotide
tgaagggagataaagtggag

SEQ ID NO: 8866 - DNA, 20 bp, Artificial Sequence
  Description of Artificial Sequence: Synthetic oligonucleotide
gaagggagataaagtggaga

SEQ ID NO: 8867 - DNA, 20 bp, Artificial Sequence
  Description of Artificial Sequence: Synthetic oligonucleotide
aagggagataaagtggagac

SEQ ID NO: 8868 - DNA, 20 bp, Artificial Sequence
  Description of Artificial Sequence: Synthetic oligonucleotide
agggagataaagtggagact

SEQ ID NO: 8869 - DNA, 20 bp, Artificial Sequence
  Description of Artificial Sequence: Synthetic oligonucleotide
gggagataaagtggagactt

SEQ ID NO: 8870 - DNA, 20 bp, Artificial Sequence
  Description of Artificial Sequence: Synthetic oligonucleotide
ggagataaagtggagacttg

SEQ ID NO: 8871 - DNA, 20 bp, Artificial Sequence
  Description of Artificial Sequence: Synthetic oligonucleotide
gagataaagtggagacttga

SEQ ID NO: 8872 - DNA, 20 bp, Artificial Sequence
  Description of Artificial Sequence: Synthetic oligonucleotide
agataaagtggagacttgaa

SEQ ID NO: 8873 - DNA, 20 bp, Artificial Sequence
  Description of Artificial Sequence: Synthetic oligonucleotide
gataaagtggagacttgaaa

SEQ ID NO: 8874 - DNA, 20 bp, Artificial Sequence
  Description of Artificial Sequence: Synthetic oligonucleotide
ataaagtggagacttgaaac

SEQ ID NO: 8875 - DNA, 20 bp, Artificial Sequence
  Description of Artificial Sequence: Synthetic oligonucleotide
taaagtggagacttgaaaca

SEQ ID NO: 8876 - DNA, 20 bp, Artificial Sequence
  Description of Artificial Sequence: Synthetic oligonucleotide
aaagtggagacttgaaacag

SEQ ID NO: 8877 - DNA, 20 bp, Artificial Sequence
  Description of Artificial Sequence: Synthetic oligonucleotide
aagtggagacttgaaacagg

SEQ ID NO: 8878 - DNA, 20 bp, Artificial Sequence
  Description of Artificial Sequence: Synthetic oligonucleotide
agtggagacttgaaacagga

SEQ ID NO: 8879 - DNA, 20 bp, Artificial Sequence
  Description of Artificial Sequence: Synthetic oligonucleotide
gtggagacttgaaacaggag

SEQ ID NO: 8880 - DNA, 20 bp, Artificial Sequence
  Description of Artificial Sequence: Synthetic oligonucleotide
tggagacttgaaacaggagg

SEQ ID NO: 8881 - DNA, 20 bp, Artificial Sequence
  Description of Artificial Sequence: Synthetic oligonucleotide
ggagacttgaaacaggaggg

SEQ ID NO: 8882 - DNA, 20 bp, Artificial Sequence
  Description of Artificial Sequence: Synthetic oligonucleotide
gagacttgaaacaggagggc

SEQ ID NO: 8883 - DNA, 20 bp, Artificial Sequence
  Description of Artificial Sequence: Synthetic oligonucleotide
agacttgaaacaggagggca

SEQ ID NO: 8884 - DNA, 20 bp, Artificial Sequence
  Description of Artificial Sequence: Synthetic oligonucleotide
gacttgaaacaggagggcag

SEQ ID NO: 8885 - DNA, 20 bp, Artificial Sequence
  Description of Artificial Sequence: Synthetic oligonucleotide
acttgaaacaggagggcagc

SEQ ID NO: 8886 - DNA, 20 bp, Artificial Sequence
  Description of Artificial Sequence: Synthetic oligonucleotide
cttgaaacaggagggcagcc

SEQ ID NO: 8887 - DNA, 20 bp, Artificial Sequence
  Description of Artificial Sequence: Synthetic oligonucleotide
ttgaaacaggagggcagccc

SEQ ID NO: 8888 - DNA, 20 bp, Artificial Sequence
  Description of Artificial Sequence: Synthetic oligonucleotide
tgaaacaggagggcagcccc

SEQ ID NO: 8889 - DNA, 20 bp, Artificial Sequence
  Description of Artificial Sequence: Synthetic oligonucleotide
gaaacaggagggcagcccct

SEQ ID NO: 8890 - DNA, 20 bp, Artificial Sequence
  Description of Artificial Sequence: Synthetic oligonucleotide
aaacaggagggcagcccctg

SEQ ID NO: 8891 - DNA, 20 bp, Artificial Sequence
  Description of Artificial Sequence: Synthetic oligonucleotide
aacaggagggcagcccctgg

SEQ ID NO: 8892 - DNA, 20 bp, Artificial Sequence
  Description of Artificial Sequence: Synthetic oligonucleotide
acaggagggcagcccctggg

SEQ ID NO: 8893 - DNA, 20 bp, Artificial Sequence
  Description of Artificial Sequence: Synthetic oligonucleotide
caggagggcagcccctgggg

SEQ ID NO: 8894 - DNA, 20 bp, Artificial Sequence
  Description of Artificial Sequence: Synthetic oligonucleotide
aggagggcagcccctggggg

SEQ ID NO: 8895 - DNA, 20 bp, Artificial Sequence
  Description of Artificial Sequence: Synthetic oligonucleotide
ggagggcagcccctgggggg

SEQ ID NO: 8896 - DNA, 20 bp, Artificial Sequence
  Description of Artificial Sequence: Synthetic oligonucleotide
gagggcagcccctggggggg

SEQ ID NO: 8897 - DNA, 20 bp, Artificial Sequence
  Description of Artificial Sequence: Synthetic oligonucleotide
agggcagcccctgggggggg

SEQ ID NO: 8898 - DNA, 20 bp, Artificial Sequence
  Description of Artificial Sequence: Synthetic oligonucleotide
gggcagcccctggggggggt

SEQ ID NO: 8899 - DNA, 20 bp, Artificial Sequence
  Description of Artificial Sequence: Synthetic oligonucleotide
ggcagcccctggggggggtc

SEQ ID NO: 8900 - DNA, 20 bp, Artificial Sequence
  Description of Artificial Sequence: Synthetic oligonucleotide
gcagcccctggggggggtct

SEQ ID NO: 8901 - DNA, 20 bp, Artificial Sequence
  Description of Artificial Sequence: Synthetic oligonucleotide
cagcccctggggggggtctc

SEQ ID NO: 8902 - DNA, 20 bp, Artificial Sequence
  Description of Artificial Sequence: Synthetic oligonucleotide
agcccctggggggggtctca

SEQ ID NO: 8903 - DNA, 20 bp, Artificial Sequence
  Description of Artificial Sequence: Synthetic oligonucleotide
gcccctggggggggtctcag

SEQ ID NO: 8904 - DNA, 20 bp, Artificial Sequence
  Description of Artificial Sequence: Synthetic oligonucleotide
cccctggggggggtctcagg

SEQ ID NO: 8905 - DNA, 20 bp, Artificial Sequence
  Description of Artificial Sequence: Synthetic oligonucleotide
ccctggggggggtctcagga

SEQ ID NO: 8906 - DNA, 20 bp, Artificial Sequence
  Description of Artificial Sequence: Synthetic oligonucleotide
cctggggggggtctcaggag

SEQ ID NO: 8907 - DNA, 20 bp, Artificial Sequence
  Description of Artificial Sequence: Synthetic oligonucleotide
ctggggggggtctcaggagc

SEQ ID NO: 8908 - DNA, 20 bp, Artificial Sequence
  Description of Artificial Sequence: Synthetic oligonucleotide
tggggggggtctcaggagcc

SEQ ID NO: 8909 - DNA, 20 bp, Artificial Sequence
  Description of Artificial Sequence: Synthetic oligonucleotide
ggggggggtctcaggagcca

SEQ ID NO: 8910 - DNA, 20 bp, Artificial Sequence
  Description of Artificial Sequence: Synthetic oligonucleotide
gggggggtctcaggagccag

SEQ ID NO: 8911 - DNA, 20 bp, Artificial Sequence
  Description of Artificial Sequence: Synthetic oligonucleotide
ggggggtctcaggagccagg

SEQ ID NO: 8912 - DNA, 20 bp, Artificial Sequence
  Description of Artificial Sequence: Synthetic oligonucleotide
gggggtctcaggagccaggc

SEQ ID NO: 8913 - DNA, 20 bp, Artificial Sequence
  Description of Artificial Sequence: Synthetic oligonucleotide
ggggtctcaggagccaggca

SEQ ID NO: 8914 - DNA, 20 bp, Artificial Sequence
  Description of Artificial Sequence: Synthetic oligonucleotide
gggtctcaggagccaggcat

SEQ ID NO: 8915 - DNA, 20 bp, Artificial Sequence
  Description of Artificial Sequence: Synthetic oligonucleotide
ggtctcaggagccaggcata

SEQ ID NO: 8916 - DNA, 20 bp, Artificial Sequence
  Description of Artificial Sequence: Synthetic oligonucleotide
gtctcaggagccaggcatat

SEQ ID NO: 8917 - DNA, 20 bp, Artificial Sequence
  Description of Artificial Sequence: Synthetic oligonucleotide
tctcaggagccaggcatatc

SEQ ID NO: 8918 - DNA, 20 bp, Artificial Sequence
  Description of Artificial Sequence: Synthetic oligonucleotide
ctcaggagccaggcatatct

SEQ ID NO: 8919 - DNA, 20 bp, Artificial Sequence
  Description of Artificial Sequence: Synthetic oligonucleotide
tcaggagccaggcatatctg

SEQ ID NO: 8920 - DNA, 20 bp, Artificial Sequence
  Description of Artificial Sequence: Synthetic oligonucleotide
caggagccaggcatatctgg

SEQ ID NO: 8921 - DNA, 20 bp, Artificial Sequence
  Description of Artificial Sequence: Synthetic oligonucleotide
aggagccaggcatatctggg

SEQ ID NO: 8922 - DNA, 20 bp, Artificial Sequence
  Description of Artificial Sequence: Synthetic oligonucleotide
ggagccaggcatatctgggg

SEQ ID NO: 8923 - DNA, 20 bp, Artificial Sequence
  Description of Artificial Sequence: Synthetic oligonucleotide
gagccaggcatatctggggg

SEQ ID NO: 8924 - DNA, 20 bp, Artificial Sequence
  Description of Artificial Sequence: Synthetic oligonucleotide
agccaggcatatctgggggc

SEQ ID NO: 8925 - DNA, 20 bp, Artificial Sequence
  Description of Artificial Sequence: Synthetic oligonucleotide
gccaggcatatctgggggct

SEQ ID NO: 8926 - DNA, 20 bp, Artificial Sequence
  Description of Artificial Sequence: Synthetic oligonucleotide
ccaggcatatctgggggctt

SEQ ID NO: 8927 - DNA, 20 bp, Artificial Sequence
  Description of Artificial Sequence: Synthetic oligonucleotide
caggcatatctgggggctta

SEQ ID NO: 8928 - DNA, 20 bp, Artificial Sequence
  Description of Artificial Sequence: Synthetic oligonucleotide
aggcatatctgggggcttaa

SEQ ID NO: 8929 - DNA, 20 bp, Artificial Sequence
  Description of Artificial Sequence: Synthetic oligonucleotide
ggcatatctgggggcttaac

SEQ ID NO: 8930 - DNA, 20 bp, Artificial Sequence
  Description of Artificial Sequence: Synthetic oligonucleotide
gcatatctgggggcttaaca

SEQ ID NO: 8931 - DNA, 20 bp, Artificial Sequence
  Description of Artificial Sequence: Synthetic oligonucleotide
catatctgggggcttaacag

SEQ ID NO: 8932 - DNA, 20 bp, Artificial Sequence
  Description of Artificial Sequence: Synthetic oligonucleotide
atatctgggggcttaacagt

SEQ ID NO: 8933 - DNA, 20 bp, Artificial Sequence
  Description of Artificial Sequence: Synthetic oligonucleotide
tatctgggggcttaacagtg

SEQ ID NO: 8934 - DNA, 20 bp, Artificial Sequence
  Description of Artificial Sequence: Synthetic oligonucleotide
atctgggggcttaacagtgg

SEQ ID NO: 8935 - DNA, 20 bp, Artificial Sequence
  Description of Artificial Sequence: Synthetic oligonucleotide
tctgggggcttaacagtgga

SEQ ID NO: 8936 - DNA, 20 bp, Artificial Sequence
  Description of Artificial Sequence: Synthetic oligonucleotide
ctgggggcttaacagtggat

SEQ ID NO: 8937 - DNA, 20 bp, Artificial Sequence
  Description of Artificial Sequence: Synthetic oligonucleotide
tgggggcttaacagtggatg

SEQ ID NO: 8938 - DNA, 20 bp, Artificial Sequence
  Description of Artificial Sequence: Synthetic oligonucleotide
gggggcttaacagtggatga

SEQ ID NO: 8939 - DNA, 20 bp, Artificial Sequence
  Description of Artificial Sequence: Synthetic oligonucleotide
ggggcttaacagtggatgac

SEQ ID NO: 8940 - DNA, 20 bp, Artificial Sequence
  Description of Artificial Sequence: Synthetic oligonucleotide
gggcttaacagtggatgacc

SEQ ID NO: 8941 - DNA, 20 bp, Artificial Sequence
  Description of Artificial Sequence: Synthetic oligonucleotide
ggcttaacagtggatgacca

SEQ ID NO: 8942 - DNA, 20 bp, Artificial Sequence
  Description of Artificial Sequence: Synthetic oligonucleotide
gcttaacagtggatgaccag

SEQ ID NO: 8943 - DNA, 20 bp, Artificial Sequence
  Description of Artificial Sequence: Synthetic oligonucleotide
cttaacagtggatgaccagg

SEQ ID NO: 8944 - DNA, 20 bp, Artificial Sequence
  Description of Artificial Sequence: Synthetic oligonucleotide
ttaacagtggatgaccaggg

SEQ ID NO: 8945 - DNA, 20 bp, Artificial Sequence
  Description of Artificial Sequence: Synthetic oligonucleotide
taacagtggatgaccaggga

SEQ ID NO: 8946 - DNA, 20 bp, Artificial Sequence
  Description of Artificial Sequence: Synthetic oligonucleotide
aacagtggatgaccagggaa

SEQ ID NO: 8947 - DNA, 20 bp, Artificial Sequence
  Description of Artificial Sequence: Synthetic oligonucleotide
acagtggatgaccagggaag

SEQ ID NO: 8948 - DNA, 20 bp, Artificial Sequence
  Description of Artificial Sequence: Synthetic oligonucleotide
cagtggatgaccagggaagt

SEQ ID NO: 8949 - DNA, 20 bp, Artificial Sequence
  Description of Artificial Sequence: Synthetic oligonucleotide
agtggatgaccagggaagta

SEQ ID NO: 8950 - DNA, 20 bp, Artificial Sequence
  Description of Artificial Sequence: Synthetic oligonucleotide
gtggatgaccagggaagtaa

SEQ ID NO: 8951 - DNA, 20 bp, Artificial Sequence
  Description of Artificial Sequence: Synthetic oligonucleotide
tggatgaccagggaagtaaa

SEQ ID NO: 8952 - DNA, 20 bp, Artificial Sequence
  Description of Artificial Sequence: Synthetic oligonucleotide
ggatgaccagggaagtaaaa

SEQ ID NO: 8953 - DNA, 20 bp, Artificial Sequence
  Description of Artificial Sequence: Synthetic oligonucleotide
gatgaccagggaagtaaaag

SEQ ID NO: 8954 - DNA, 20 bp, Artificial Sequence
  Description of Artificial Sequence: Synthetic oligonucleotide
atgaccagggaagtaaaagg

SEQ ID NO: 8955 - DNA, 20 bp, Artificial Sequence
  Description of Artificial Sequence: Synthetic oligonucleotide
tgaccagggaagtaaaaggc

SEQ ID NO: 8956 - DNA, 20 bp, Artificial Sequence
  Description of Artificial Sequence: Synthetic oligonucleotide
gaccagggaagtaaaaggca

SEQ ID NO: 8957 - DNA, 20 bp, Artificial Sequence
  Description of Artificial Sequence: Synthetic oligonucleotide
accagggaagtaaaaggcaa

SEQ ID NO: 8958 - DNA, 20 bp, Artificial Sequence
  Description of Artificial Sequence: Synthetic oligonucleotide
ccagggaagtaaaaggcaaa

SEQ ID NO: 8959 - DNA, 20 bp, Artificial Sequence
  Description of Artificial Sequence: Synthetic oligonucleotide
cagggaagtaaaaggcaaat

SEQ ID NO: 8960 - DNA, 20 bp, Artificial Sequence
  Description of Artificial Sequence: Synthetic oligonucleotide
agggaagtaaaaggcaaatc

SEQ ID NO: 8961 - DNA, 20 bp, Artificial Sequence
  Description of Artificial Sequence: Synthetic oligonucleotide
gggaagtaaaaggcaaatct

SEQ ID NO: 8962 - DNA, 20 bp, Artificial Sequence
  Description of Artificial Sequence: Synthetic oligonucleotide
ggaagtaaaaggcaaatctt

SEQ ID NO: 8963 - DNA, 20 bp, Artificial Sequence
  Description of Artificial Sequence: Synthetic oligonucleotide
gaagtaaaaggcaaatctta

SEQ ID NO: 8964 - DNA, 20 bp, Artificial Sequence
  Description of Artificial Sequence: Synthetic oligonucleotide
aagtaaaaggcaaatcttat

SEQ ID NO: 8965 - DNA, 20 bp, Artificial Sequence
  Description of Artificial Sequence: Synthetic oligonucleotide
agtaaaaggcaaatcttatc

SEQ ID NO: 8966 - DNA, 20 bp, Artificial Sequence
  Description of Artificial Sequence: Synthetic oligonucleotide
gtaaaaggcaaatcttatct

SEQ ID NO: 8967 - DNA, 20 bp, Artificial Sequence
  Description of Artificial Sequence: Synthetic oligonucleotide
taaaaggcaaatcttatctc

SEQ ID NO: 8968 - DNA, 20 bp, Artificial Sequence
  Description of Artificial Sequence: Synthetic oligonucleotide
aaaaggcaaatcttatctca

SEQ ID NO: 8969 - DNA, 20 bp, Artificial Sequence
  Description of Artificial Sequence: Synthetic oligonucleotide
aaaggcaaatcttatctcat

SEQ ID NO: 8970 - DNA, 20 bp, Artificial Sequence
  Description of Artificial Sequence: Synthetic oligonucleotide
aaggcaaatcttatctcatg

SEQ ID NO: 8971 - DNA, 20 bp, Artificial Sequence
  Description of Artificial Sequence: Synthetic oligonucleotide
aggcaaatcttatctcatga

SEQ ID NO: 8972 - DNA, 20 bp, Artificial Sequence
  Description of Artificial Sequence: Synthetic oligonucleotide
ggcaaatcttatctcatgac

SEQ ID NO: 8973 - DNA, 20 bp, Artificial Sequence
  Description of Artificial Sequence: Synthetic oligonucleotide
gcaaatcttatctcatgacc

SEQ ID NO: 8974 - DNA, 20 bp, Artificial Sequence
  Description of Artificial Sequence: Synthetic oligonucleotide
caaatcttatctcatgacca

SEQ ID NO: 8975 - DNA, 20 bp, Artificial Sequence
  Description of Artificial Sequence: Synthetic oligonucleotide
aaatcttatctcatgaccac

SEQ ID NO: 8976 - DNA, 20 bp, Artificial Sequence
  Description of Artificial Sequence: Synthetic oligonucleotide
aatcttatctcatgaccacc

SEQ ID NO: 8977 - DNA, 20 bp, Artificial Sequence
  Description of Artificial Sequence: Synthetic oligonucleotide
atcttatctcatgaccacct

SEQ ID NO: 8978 - DNA, 20 bp, Artificial Sequence
  Description of Artificial Sequence: Synthetic oligonucleotide
tcttatctcatgaccacctc

SEQ ID NO: 8979 - DNA, 20 bp, Artificial Sequence
  Description of Artificial Sequence: Synthetic oligonucleotide
cttatctcatgaccacctct

SEQ ID NO: 8980 - DNA, 20 bp, Artificial Sequence
  Description of Artificial Sequence: Synthetic oligonucleotide
ttatctcatgaccacctctc

SEQ ID NO: 8981 - DNA, 20 bp, Artificial Sequence
  Description of Artificial Sequence: Synthetic oligonucleotide
tatctcatgaccacctctct

SEQ ID NO: 8982 - DNA, 20 bp, Artificial Sequence
  Description of Artificial Sequence: Synthetic oligonucleotide
atctcatgaccacctctctg

SEQ ID NO: 8983 - DNA, 20 bp, Artificial Sequence
  Description of Artificial Sequence: Synthetic oligonucleotide
tctcatgaccacctctctgc

SEQ ID NO: 8984 - DNA, 20 bp, Artificial Sequence
  Description of Artificial Sequence: Synthetic oligonucleotide
ctcatgaccacctctctgcc

SEQ ID NO: 8985 - DNA, 20 bp, Artificial Sequence
  Description of Artificial Sequence: Synthetic oligonucleotide
tcatgaccacctctctgcca

SEQ ID NO: 8986 - DNA, 20 bp, Artificial Sequence
  Description of Artificial Sequence: Synthetic oligonucleotide
catgaccacctctctgccat

SEQ ID NO: 8987 - DNA, 20 bp, Artificial Sequence
  Description of Artificial Sequence: Synthetic oligonucleotide
atgaccacctctctgccatc

SEQ ID NO: 8988 - DNA, 20 bp, Artificial Sequence
  Description of Artificial Sequence: Synthetic oligonucleotide
tgaccacctctctgccatct

SEQ ID NO: 8989 - DNA, 20 bp, Artificial Sequence
  Description of Artificial Sequence: Synthetic oligonucleotide
gaccacctctctgccatctg

SEQ ID NO: 8990 - DNA, 20 bp, Artificial Sequence
  Description of Artificial Sequence: Synthetic oligonucleotide
accacctctctgccatctgc

SEQ ID NO: 8991 - DNA, 20 bp, Artificial Sequence
  Description of Artificial Sequence: Synthetic oligonucleotide
ccacctctctgccatctgcc

SEQ ID NO: 8992 - DNA, 20 bp, Artificial Sequence
  Description of Artificial Sequence: Synthetic oligonucleotide
cacctctctgccatctgcct

SEQ ID NO: 8993 - DNA, 20 bp, Artificial Sequence
  Description of Artificial Sequence: Synthetic oligonucleotide
acctctctgccatctgccta

SEQ ID NO: 8994 - DNA, 20 bp, Artificial Sequence
  Description of Artificial Sequence: Synthetic oligonucleotide
cctctctgccatctgcctaa

SEQ ID NO: 8995 - DNA, 20 bp, Artificial Sequence
  Description of Artificial Sequence: Synthetic oligonucleotide
ctctctgccatctgcctaac

SEQ ID NO: 8996 - DNA, 20 bp, Artificial Sequence
  Description of Artificial Sequence: Synthetic oligonucleotide
tctctgccatctgcctaacc

SEQ ID NO: 8997 - DNA, 20 bp, Artificial Sequence
  Description of Artificial Sequence: Synthetic oligonucleotide
ctctgccatctgcctaacct

SEQ ID NO: 8998 - DNA, 20 bp, Artificial Sequence
  Description of Artificial Sequence: Synthetic oligonucleotide
tctgccatctgcctaacctc

SEQ ID NO: 8999 - DNA, 20 bp, Artificial Sequence
  Description of Artificial Sequence: Synthetic oligonucleotide
ctgccatctgcctaacctct

SEQ ID NO: 9000 - DNA, 20 bp, Artificial Sequence
  Description of Artificial Sequence: Synthetic oligonucleotide
tgccatctgcctaacctctt

SEQ ID NO: 9001 - DNA, 20 bp, Artificial Sequence
  Description of Artificial Sequence: Synthetic oligonucleotide
gccatctgcctaacctcttc

SEQ ID NO: 9002 - DNA, 20 bp, Artificial Sequence
  Description of Artificial Sequence: Synthetic oligonucleotide
ccatctgcctaacctcttcc

SEQ ID NO: 9003 - DNA, 20 bp, Artificial Sequence
  Description of Artificial Sequence: Synthetic oligonucleotide
catctgcctaacctcttcca

SEQ ID NO: 9004 - DNA, 20 bp, Artificial Sequence
  Description of Artificial Sequence: Synthetic oligonucleotide
atctgcctaacctcttccat

SEQ ID NO: 9005 - DNA, 20 bp, Artificial Sequence
  Description of Artificial Sequence: Synthetic oligonucleotide
tctgcctaacctcttccatg

SEQ ID NO: 9006 - DNA, 20 bp, Artificial Sequence
  Description of Artificial Sequence: Synthetic oligonucleotide
ctgcctaacctcttccatgg

SEQ ID NO: 9007 - DNA, 20 bp, Artificial Sequence
  Description of Artificial Sequence: Synthetic oligonucleotide
tgcctaacctcttccatggc

SEQ ID NO: 9008 - DNA, 20 bp, Artificial Sequence
  Description of Artificial Sequence: Synthetic oligonucleotide
gcctaacctcttccatggct

SEQ ID NO: 9009 - DNA, 20 bp, Artificial Sequence
  Description of Artificial Sequence: Synthetic oligonucleotide
cctaacctcttccatggctc

SEQ ID NO: 9010 - DNA, 20 bp, Artificial Sequence
  Description of Artificial Sequence: Synthetic oligonucleotide
ctaacctcttccatggctcc

SEQ ID NO: 9011 - DNA, 20 bp, Artificial Sequence
  Description of Artificial Sequence: Synthetic oligonucleotide
taacctcttccatggctccc

SEQ ID NO: 9012 - DNA, 20 bp, Artificial Sequence
  Description of Artificial Sequence: Synthetic oligonucleotide
aacctcttccatggctccct

SEQ ID NO: 9013 - DNA, 20 bp, Artificial Sequence
  Description of Artificial Sequence: Synthetic oligonucleotide
acctcttccatggctcccta

SEQ ID NO: 9014 - DNA, 20 bp, Artificial Sequence
  Description of Artificial Sequence: Synthetic oligonucleotide
cctcttccatggctccctat

SEQ ID NO: 9015 - DNA, 20 bp, Artificial Sequence
  Description of Artificial Sequence: Synthetic oligonucleotide
ctcttccatggctccctatg

SEQ ID NO: 9016 - DNA, 20 bp, Artificial Sequence
  Description of Artificial Sequence: Synthetic oligonucleotide
tcttccatggctccctatgt

SEQ ID NO: 9017 - DNA, 20 bp, Artificial Sequence
  Description of Artificial Sequence: Synthetic oligonucleotide
cttccatggctccctatgtc

SEQ ID NO: 9018 - DNA, 20 bp, Artificial Sequence
  Description of Artificial Sequence: Synthetic oligonucleotide
ttccatggctccctatgtcc

SEQ ID NO: 9019 - DNA, 20 bp, Artificial Sequence
  Description of Artificial Sequence: Synthetic oligonucleotide
tccatggctccctatgtcct

SEQ ID NO: 9020 - DNA, 20 bp, Artificial Sequence
  Description of Artificial Sequence: Synthetic oligonucleotide
ccatggctccctatgtcctt

SEQ ID NO: 9021 - DNA, 20 bp, Artificial Sequence
  Description of Artificial Sequence: Synthetic oligonucleotide
catggctccctatgtccttc

SEQ ID NO: 9022 - DNA, 20 bp, Artificial Sequence
  Description of Artificial Sequence: Synthetic oligonucleotide
atggctccctatgtccttcc

SEQ ID NO: 9023 - DNA, 20 bp, Artificial Sequence
  Description of Artificial Sequence: Synthetic oligonucleotide
tggctccctatgtccttcct

SEQ ID NO: 9024 - DNA, 20 bp, Artificial Sequence
  Description of Artificial Sequence: Synthetic oligonucleotide
ggctccctatgtccttcctc

SEQ ID NO: 9025 - DNA, 20 bp, Artificial Sequence
  Description of Artificial Sequence: Synthetic oligonucleotide
gctccctatgtccttcctca

SEQ ID NO: 9026 - DNA, 20 bp, Artificial Sequence
  Description of Artificial Sequence: Synthetic oligonucleotide
ctccctatgtccttcctcag

SEQ ID NO: 9027 - DNA, 20 bp, Artificial Sequence
  Description of Artificial Sequence: Synthetic oligonucleotide
tccctatgtccttcctcagc

SEQ ID NO: 9028 - DNA, 20 bp, Artificial Sequence
  Description of Artificial Sequence: Synthetic oligonucleotide
ccctatgtccttcctcagca

SEQ ID NO: 9029 - DNA, 20 bp, Artificial Sequence
  Description of Artificial Sequence: Synthetic oligonucleotide
cctatgtccttcctcagcat

SEQ ID NO: 9030 - DNA, 20 bp, Artificial Sequence
  Description of Artificial Sequence: Synthetic oligonucleotide
ctatgtccttcctcagcatg

SEQ ID NO: 9031 - DNA, 20 bp, Artificial Sequence
  Description of Artificial Sequence: Synthetic oligonucleotide
tatgtccttcctcagcatgg

SEQ ID NO: 9032 - DNA, 20 bp, Artificial Sequence
  Description of Artificial Sequence: Synthetic oligonucleotide
atgtccttcctcagcatggt

SEQ ID NO: 9033 - DNA, 20 bp, Artificial Sequence
  Description of Artificial Sequence: Synthetic oligonucleotide
tgtccttcctcagcatggtc

SEQ ID NO: 9034 - DNA, 20 bp, Artificial Sequence
  Description of Artificial Sequence: Synthetic oligonucleotide
gtccttcctcagcatggtcc

SEQ ID NO: 9035 - DNA, 20 bp, Artificial Sequence
  Description of Artificial Sequence: Synthetic oligonucleotide
tccttcctcagcatggtcca

SEQ ID NO: 9036 - DNA, 20 bp, Artificial Sequence
  Description of Artificial Sequence: Synthetic oligonucleotide
ccttcctcagcatggtccac

SEQ ID NO: 9037 - DNA, 20 bp, Artificial Sequence
  Description of Artificial Sequence: Synthetic oligonucleotide
cttcctcagcatggtccaca

SEQ ID NO: 9038 - DNA, 20 bp, Artificial Sequence
  Description of Artificial Sequence: Synthetic oligonucleotide
ttcctcagcatggtccacaa

SEQ ID NO: 9039 - DNA, 20 bp, Artificial Sequence
  Description of Artificial Sequence: Synthetic oligonucleotide
tcctcagcatggtccacaag

SEQ ID NO: 9040 - DNA, 20 bp, Artificial Sequence
  Description of Artificial Sequence: Synthetic oligonucleotide
cctcagcatggtccacaagg

SEQ ID NO: 9041 - DNA, 20 bp, Artificial Sequence
  Description of Artificial Sequence: Synthetic oligonucleotide
ctcagcatggtccacaaggc

SEQ ID NO: 9042 - DNA, 20 bp, Artificial Sequence
  Description of Artificial Sequence: Synthetic oligonucleotide
tcagcatggtccacaaggca

SEQ ID NO: 9043 - DNA, 20 bp, Artificial Sequence
  Description of Artificial Sequence: Synthetic oligonucleotide
cagcatggtccacaaggcac

SEQ ID NO: 9044 - DNA, 20 bp, Artificial Sequence
  Description of Artificial Sequence: Synthetic oligonucleotide
agcatggtccacaaggcacc

SEQ ID NO: 9045 - DNA, 20 bp, Artificial Sequence
  Description of Artificial Sequence: Synthetic oligonucleotide
gcatggtccacaaggcacct

SEQ ID NO: 9046 - DNA, 20 bp, Artificial Sequence
  Description of Artificial Sequence: Synthetic oligonucleotide
catggtccacaaggcacctg

SEQ ID NO: 9047 - DNA, 20 bp, Artificial Sequence
  Description of Artificial Sequence: Synthetic oligonucleotide
atggtccacaaggcacctgg

SEQ ID NO: 9048 - DNA, 20 bp, Artificial Sequence
  Description of Artificial Sequence: Synthetic oligonucleotide
tggtccacaaggcacctgga

SEQ ID NO: 9049 - DNA, 20 bp, Artificial Sequence
  Description of Artificial Sequence: Synthetic oligonucleotide
ggtccacaaggcacctggag

SEQ ID NO: 9050 - DNA, 20 bp, Artificial Sequence
  Description of Artificial Sequence: Synthetic oligonucleotide
gtccacaaggcacctggagg

SEQ ID NO: 9051 - DNA, 20 bp, Artificial Sequence
  Description of Artificial Sequence: Synthetic oligonucleotide
tccacaaggcacctggagga

SEQ ID NO: 9052 - DNA, 20 bp, Artificial Sequence
  Description of Artificial Sequence: Synthetic oligonucleotide
ccacaaggcacctggaggac

SEQ ID NO: 9053 - DNA, 20 bp, Artificial Sequence
  Description of Artificial Sequence: Synthetic oligonucleotide
cacaaggcacctggaggacc

SEQ ID NO: 9054 - DNA, 20 bp, Artificial Sequence
  Description of Artificial Sequence: Synthetic oligonucleotide
acaaggcacctggaggacca

SEQ ID NO: 9055 - DNA, 20 bp, Artificial Sequence
  Description of Artificial Sequence: Synthetic oligonucleotide
caaggcacctggaggaccag

SEQ ID NO: 9056 - DNA, 20 bp, Artificial Sequence
  Description of Artificial Sequence: Synthetic oligonucleotide
aaggcacctggaggaccagc

SEQ ID NO: 9057 - DNA, 20 bp, Artificial Sequence
  Description of Artificial Sequence: Synthetic oligonucleotide
aggcacctggaggaccagcc

SEQ ID NO: 9058 - DNA, 20 bp, Artificial Sequence
  Description of Artificial Sequence: Synthetic oligonucleotide
ggcacctggaggaccagccc

SEQ ID NO: 9059 - DNA, 20 bp, Artificial Sequence
  Description of Artificial Sequence: Synthetic oligonucleotide
gcacctggaggaccagcccc

SEQ ID NO: 9060 - DNA, 20 bp, Artificial Sequence
  Description of Artificial Sequence: Synthetic oligonucleotide
cacctggaggaccagccccc

SEQ ID NO: 9061 - DNA, 20 bp, Artificial Sequence
  Description of Artificial Sequence: Synthetic oligonucleotide
acctggaggaccagcccccg

SEQ ID NO: 9062 - DNA, 20 bp, Artificial Sequence
  Description of Artificial Sequence: Synthetic oligonucleotide
cctggaggaccagcccccgt

SEQ ID NO: 9063 - DNA, 20 bp, Artificial Sequence
  Description of Artificial Sequence: Synthetic oligonucleotide
ctggaggaccagcccccgtg

SEQ ID NO: 9064 - DNA, 20 bp, Artificial Sequence
  Description of Artificial Sequence: Synthetic oligonucleotide
tggaggaccagcccccgtgc

SEQ ID NO: 9065 - DNA, 20 bp, Artificial Sequence
  Description of Artificial Sequence: Synthetic oligonucleotide
ggaggaccagcccccgtgcc

SEQ ID NO: 9066 - DNA, 20 bp, Artificial Sequence
  Description of Artificial Sequence: Synthetic oligonucleotide
gaggaccagcccccgtgccc

SEQ ID NO: 9067 - DNA, 20 bp, Artificial Sequence
  Description of Artificial Sequence: Synthetic oligonucleotide
aggaccagcccccgtgccca

SEQ ID NO: 9068 - DNA, 20 bp, Artificial Sequence
  Description of Artificial Sequence: Synthetic oligonucleotide
ggaccagcccccgtgcccat

SEQ ID NO: 9069 - DNA, 20 bp, Artificial Sequence
  Description of Artificial Sequence: Synthetic oligonucleotide
gaccagcccccgtgcccatc

SEQ ID NO: 9070 - DNA, 20 bp, Artificial Sequence
  Description of Artificial Sequence: Synthetic oligonucleotide
accagcccccgtgcccatcc

SEQ ID NO: 9071 - DNA, 20 bp, Artificial Sequence
  Description of Artificial Sequence: Synthetic oligonucleotide
ccagcccccgtgcccatcct

SEQ ID NO: 9072 - DNA, 20 bp, Artificial Sequence
  Description of Artificial Sequence: Synthetic oligonucleotide
cagcccccgtgcccatcctc

SEQ ID NO: 9073 - DNA, 20 bp, Artificial Sequence
  Description of Artificial Sequence: Synthetic oligonucleotide
agcccccgtgcccatcctcc

SEQ ID NO: 9074 - DNA, 20 bp, Artificial Sequence
  Description of Artificial Sequence: Synthetic oligonucleotide
gcccccgtgcccatcctcct

SEQ ID NO: 9075 - DNA, 20 bp, Artificial Sequence
  Description of Artificial Sequence: Synthetic oligonucleotide
cccccgtgcccatcctcctc

SEQ ID NO: 9076 - DNA, 20 bp, Artificial Sequence
  Description of Artificial Sequence: Synthetic oligonucleotide
ccccgtgcccatcctcctcc

SEQ ID NO: 9077 - DNA, 20 bp, Artificial Sequence
  Description of Artificial Sequence: Synthetic oligonucleotide
cccgtgcccatcctcctcct

SEQ ID NO: 9078 - DNA, 20 bp, Artificial Sequence
  Description of Artificial Sequence: Synthetic oligonucleotide
ccgtgcccatcctcctcctg

SEQ ID NO: 9079 - DNA, 20 bp, Artificial Sequence
  Description of Artificial Sequence: Synthetic oligonucleotide
cgtgcccatcctcctcctgc

SEQ ID NO: 9080 - DNA, 20 bp, Artificial Sequence
  Description of Artificial Sequence: Synthetic oligonucleotide
gtgcccatcctcctcctgcc

SEQ ID NO: 9081 - DNA, 20 bp, Artificial Sequence
  Description of Artificial Sequence: Synthetic oligonucleotide
tgcccatcctcctcctgcca

SEQ ID NO: 9082 - DNA, 20 bp, Artificial Sequence
  Description of Artificial Sequence: Synthetic oligonucleotide
gcccatcctcctcctgccat

SEQ ID NO: 9083 - DNA, 20 bp, Artificial Sequence
  Description of Artificial Sequence: Synthetic oligonucleotide
cccatcctcctcctgccatg

SEQ ID NO: 9084 - DNA, 20 bp, Artificial Sequence
  Description of Artificial Sequence: Synthetic oligonucleotide
ccatcctcctcctgccatgc

SEQ ID NO: 9085 - DNA, 20 bp, Artificial Sequence
  Description of Artificial Sequence: Synthetic oligonucleotide
catcctcctcctgccatgct

SEQ ID NO: 9086 - DNA, 20 bp, Artificial Sequence
  Description of Artificial Sequence: Synthetic oligonucleotide
atcctcctcctgccatgctg

SEQ ID NO: 9087 - DNA, 20 bp, Artificial Sequence
  Description of Artificial Sequence: Synthetic oligonucleotide
tcctcctcctgccatgctgt

SEQ ID NO: 9088 - DNA, 20 bp, Artificial Sequence
  Description of Artificial Sequence: Synthetic oligonucleotide
cctcctcctgccatgctgta

SEQ ID NO: 9089 - DNA, 20 bp, Artificial Sequence
  Description of Artificial Sequence: Synthetic oligonucleotide
ctcctcctgccatgctgtac

SEQ ID NO: 9090 - DNA, 20 bp, Artificial Sequence
  Description of Artificial Sequence: Synthetic oligonucleotide
tcctcctgccatgctgtacc

SEQ ID NO: 9091 - DNA, 20 bp, Artificial Sequence
  Description of Artificial Sequence: Synthetic oligonucleotide
cctcctgccatgctgtaccc

SEQ ID NO: 9092 - DNA, 20 bp, Artificial Sequence
  Description of Artificial Sequence: Synthetic oligonucleotide
ctcctgccatgctgtaccca

SEQ ID NO: 9093 - DNA, 20 bp, Artificial Sequence
  Description of Artificial Sequence: Synthetic oligonucleotide
tcctgccatgctgtacccac

SEQ ID NO: 9094 - DNA, 20 bp, Artificial Sequence
  Description of Artificial Sequence: Synthetic oligonucleotide
cctgccatgctgtacccaca

SEQ ID NO: 9095 - DNA, 20 bp, Artificial Sequence
  Description of Artificial Sequence: Synthetic oligonucleotide
ctgccatgctgtacccacac

SEQ ID NO: 9096 - DNA, 20 bp, Artificial Sequence
  Description of Artificial Sequence: Synthetic oligonucleotide
tgccatgctgtacccacacc

SEQ ID NO: 9097 - DNA, 20 bp, Artificial Sequence
  Description of Artificial Sequence: Synthetic oligonucleotide
gccatgctgtacccacaccc

SEQ ID NO: 9098 - DNA, 20 bp, Artificial Sequence
  Description of Artificial Sequence: Synthetic oligonucleotide
ccatgctgtacccacaccct

SEQ ID NO: 9099 - DNA, 20 bp, Artificial Sequence
  Description of Artificial Sequence: Synthetic oligonucleotide
catgctgtacccacaccctc

SEQ ID NO: 9100 - DNA, 20 bp, Artificial Sequence
  Description of Artificial Sequence: Synthetic oligonucleotide
atgctgtacccacaccctct

SEQ ID NO: 9101 - DNA, 20 bp, Artificial Sequence
  Description of Artificial Sequence: Synthetic oligonucleotide
tgctgtacccacaccctctc

SEQ ID NO: 9102 - DNA, 20 bp, Artificial Sequence
  Description of Artificial Sequence: Synthetic oligonucleotide
gctgtacccacaccctctct

SEQ ID NO: 9103 - DNA, 20 bp, Artificial Sequence
  Description of Artificial Sequence: Synthetic oligonucleotide
ctgtacccacaccctctctg

SEQ ID NO: 9104 - DNA, 20 bp, Artificial Sequence
  Description of Artificial Sequence: Synthetic oligonucleotide
tgtacccacaccctctctgg

SEQ ID NO: 9105 - DNA, 20 bp, Artificial Sequence
  Description of Artificial Sequence: Synthetic oligonucleotide
gtacccacaccctctctggc

SEQ ID NO: 9106 - DNA, 20 bp, Artificial Sequence
  Description of Artificial Sequence: Synthetic oligonucleotide
tacccacaccctctctggca

SEQ ID NO: 9107 - DNA, 20 bp, Artificial Sequence
  Description of Artificial Sequence: Synthetic oligonucleotide
acccacaccctctctggcac

SEQ ID NO: 9108 - DNA, 20 bp, Artificial Sequence
  Description of Artificial Sequence: Synthetic oligonucleotide
cccacaccctctctggcaca

SEQ ID NO: 9109 - DNA, 20 bp, Artificial Sequence
  Description of Artificial Sequence: Synthetic oligonucleotide
ccacaccctctctggcacac

SEQ ID NO: 9110 - DNA, 20 bp, Artificial Sequence
  Description of Artificial Sequence: Synthetic oligonucleotide
cacaccctctctggcacaca

SEQ ID NO: 9111 - DNA, 20 bp, Artificial Sequence
  Description of Artificial Sequence: Synthetic oligonucleotide
acaccctctctggcacacag

SEQ ID NO: 9112 - DNA, 20 bp, Artificial Sequence
  Description of Artificial Sequence: Synthetic oligonucleotide
caccctctctggcacacagg

SEQ ID NO: 9113 - DNA, 20 bp, Artificial Sequence
  Description of Artificial Sequence: Synthetic oligonucleotide
accctctctggcacacaggc

SEQ ID NO: 9114 - DNA, 20 bp, Artificial Sequence
  Description of Artificial Sequence: Synthetic oligonucleotide
ccctctctggcacacaggct

SEQ ID NO: 9115 - DNA, 20 bp, Artificial Sequence
  Description of Artificial Sequence: Synthetic oligonucleotide
cctctctggcacacaggctt

SEQ ID NO: 9116 - DNA, 20 bp, Artificial Sequence
  Description of Artificial Sequence: Synthetic oligonucleotide
ctctctggcacacaggcttt

SEQ ID NO: 9117 - DNA, 20 bp, Artificial Sequence
  Description of Artificial Sequence: Synthetic oligonucleotide
tctctggcacacaggctttc

SEQ ID NO: 9118 - DNA, 20 bp, Artificial Sequence
  Description of Artificial Sequence: Synthetic oligonucleotide
ctctggcacacaggctttct

SEQ ID NO: 9119 - DNA, 20 bp, Artificial Sequence
  Description of Artificial Sequence: Synthetic oligonucleotide
tctggcacacaggctttctt

SEQ ID NO: 9120 - DNA, 20 bp, Artificial Sequence
  Description of Artificial Sequence: Synthetic oligonucleotide
ctggcacacaggctttcttc

SEQ ID NO: 9121 - DNA, 20 bp, Artificial Sequence
  Description of Artificial Sequence: Synthetic oligonucleotide
tggcacacaggctttcttcc

SEQ ID NO: 9122 - DNA, 20 bp, Artificial Sequence
  Description of Artificial Sequence: Synthetic oligonucleotide
ggcacacaggctttcttccc

SEQ ID NO: 9123 - DNA, 20 bp, Artificial Sequence
  Description of Artificial Sequence: Synthetic oligonucleotide
gcacacaggctttcttccca

SEQ ID NO: 9124 - DNA, 20 bp, Artificial Sequence
  Description of Artificial Sequence: Synthetic oligonucleotide
cacacaggctttcttcccac

SEQ ID NO: 9125 - DNA, 20 bp, Artificial Sequence
  Description of Artificial Sequence: Synthetic oligonucleotide
acacaggctttcttcccacc

SEQ ID NO: 9126 - DNA, 20 bp, Artificial Sequence
  Description of Artificial Sequence: Synthetic oligonucleotide
cacaggctttcttcccaccc

SEQ ID NO: 9127 - DNA, 20 bp, Artificial Sequence
  Description of Artificial Sequence: Synthetic oligonucleotide
acaggctttcttcccaccct

SEQ ID NO: 9128 - DNA, 20 bp, Artificial Sequence
  Description of Artificial Sequence: Synthetic oligonucleotide
caggctttcttcccaccctt

SEQ ID NO: 9129 - DNA, 20 bp, Artificial Sequence
  Description of Artificial Sequence: Synthetic oligonucleotide
aggctttcttcccacccttg

SEQ ID NO: 9130 - DNA, 20 bp, Artificial Sequence
  Description of Artificial Sequence: Synthetic oligonucleotide
ggctttcttcccacccttgt

SEQ ID NO: 9131 - DNA, 20 bp, Artificial Sequence
  Description of Artificial Sequence: Synthetic oligonucleotide
gctttcttcccacccttgta

SEQ ID NO: 9132 - DNA, 20 bp, Artificial Sequence
  Description of Artificial Sequence: Synthetic oligonucleotide
ctttcttcccacccttgtac

SEQ ID NO: 9133 - DNA, 20 bp, Artificial Sequence
  Description of Artificial Sequence: Synthetic oligonucleotide
tttcttcccacccttgtacc

SEQ ID NO: 9134 - DNA, 20 bp, Artificial Sequence
  Description of Artificial Sequence: Synthetic oligonucleotide
ttcttcccacccttgtacca

SEQ ID NO: 9135 - DNA, 20 bp, Artificial Sequence
  Description of Artificial Sequence: Synthetic oligonucleotide
tcttcccacccttgtaccac

SEQ ID NO: 9136 - DNA, 20 bp, Artificial Sequence
  Description of Artificial Sequence: Synthetic oligonucleotide
cttcccacccttgtaccaca

SEQ ID NO: 9137 - DNA, 20 bp, Artificial Sequence
  Description of Artificial Sequence: Synthetic oligonucleotide
ttcccacccttgtaccacac

SEQ ID NO: 9138 - DNA, 20 bp, Artificial Sequence
  Description of Artificial Sequence: Synthetic oligonucleotide
tcccacccttgtaccacaca

SEQ ID NO: 9139 - DNA, 20 bp, Artificial Sequence
  Description of Artificial Sequence: Synthetic oligonucleotide
cccacccttgtaccacacac

SEQ ID NO: 9140 - DNA, 20 bp, Artificial Sequence
  Description of Artificial Sequence: Synthetic oligonucleotide
ccacccttgtaccacacacc

SEQ ID NO: 9141 - DNA, 20 bp, Artificial Sequence
  Description of Artificial Sequence: Synthetic oligonucleotide
cacccttgtaccacacaccg

SEQ ID NO: 9142 - DNA, 20 bp, Artificial Sequence
  Description of Artificial Sequence: Synthetic oligonucleotide
acccttgtaccacacaccgt

SEQ ID NO: 9143 - DNA, 20 bp, Artificial Sequence
  Description of Artificial Sequence: Synthetic oligonucleotide
cccttgtaccacacaccgtc

SEQ ID NO: 9144 - DNA, 20 bp, Artificial Sequence
  Description of Artificial Sequence: Synthetic oligonucleotide
ccttgtaccacacaccgtcc

SEQ ID NO: 9145 - DNA, 20 bp, Artificial Sequence
  Description of Artificial Sequence: Synthetic oligonucleotide
cttgtaccacacaccgtcct

SEQ ID NO: 9146 - DNA, 20 bp, Artificial Sequence
  Description of Artificial Sequence: Synthetic oligonucleotide
ttgtaccacacaccgtcctg

SEQ ID NO: 9147 - DNA, 20 bp, Artificial Sequence
  Description of Artificial Sequence: Synthetic oligonucleotide
tgtaccacacaccgtcctgc

SEQ ID NO: 9148 - DNA, 20 bp, Artificial Sequence
  Description of Artificial Sequence: Synthetic oligonucleotide
gtaccacacaccgtcctgcc

SEQ ID NO: 9149 - DNA, 20 bp, Artificial Sequence
  Description of Artificial Sequence: Synthetic oligonucleotide
taccacacaccgtcctgcca

SEQ ID NO: 9150 - DNA, 20 bp, Artificial Sequence
  Description of Artificial Sequence: Synthetic oligonucleotide
accacacaccgtcctgccac

SEQ ID NO: 9151 - DNA, 20 bp, Artificial Sequence
  Description of Artificial Sequence: Synthetic oligonucleotide
ccacacaccgtcctgccaca

SEQ ID NO: 9152 - DNA, 20 bp, Artificial Sequence
  Description of Artificial Sequence: Synthetic oligonucleotide
cacacaccgtcctgccacag

SEQ ID NO: 9153 - DNA, 20 bp, Artificial Sequence
  Description of Artificial Sequence: Synthetic oligonucleotide
acacaccgtcctgccacagg

SEQ ID NO: 9154 - DNA, 20 bp, Artificial Sequence
  Description of Artificial Sequence: Synthetic oligonucleotide
cacaccgtcctgccacaggg

SEQ ID NO: 9155 - DNA, 20 bp, Artificial Sequence
  Description of Artificial Sequence: Synthetic oligonucleotide
acaccgtcctgccacaggga

SEQ ID NO: 9156 - DNA, 20 bp, Artificial Sequence
  Description of Artificial Sequence: Synthetic oligonucleotide
caccgtcctgccacagggac

SEQ ID NO: 9157 - DNA, 20 bp, Artificial Sequence
  Description of Artificial Sequence: Synthetic oligonucleotide
accgtcctgccacagggact

SEQ ID NO: 9158 - DNA, 20 bp, Artificial Sequence
  Description of Artificial Sequence: Synthetic oligonucleotide
ccgtcctgccacagggactt

SEQ ID NO: 9159 - DNA, 20 bp, Artificial Sequence
  Description of Artificial Sequence: Synthetic oligonucleotide
cgtcctgccacagggacttt

SEQ ID NO: 9160 - DNA, 20 bp, Artificial Sequence
  Description of Artificial Sequence: Synthetic oligonucleotide
gtcctgccacagggactttg

SEQ ID NO: 9161 - DNA, 20 bp, Artificial Sequence
  Description of Artificial Sequence: Synthetic oligonucleotide
tcctgccacagggactttgc

SEQ ID NO: 9162 - DNA, 20 bp, Artificial Sequence
  Description of Artificial Sequence: Synthetic oligonucleotide
cctgccacagggactttgca

SEQ ID NO: 9163 - DNA, 20 bp, Artificial Sequence
  Description of Artificial Sequence: Synthetic oligonucleotide
ctgccacagggactttgcac

SEQ ID NO: 9164 - DNA, 20 bp, Artificial Sequence
  Description of Artificial Sequence: Synthetic oligonucleotide
tgccacagggactttgcaca

SEQ ID NO: 9165 - DNA, 20 bp, Artificial Sequence
  Description of Artificial Sequence: Synthetic oligonucleotide
gccacagggactttgcacat

SEQ ID NO: 9166 - DNA, 20 bp, Artificial Sequence
  Description of Artificial Sequence: Synthetic oligonucleotide
ccacagggactttgcacatg

SEQ ID NO: 9167 - DNA, 20 bp, Artificial Sequence
  Description of Artificial Sequence: Synthetic oligonucleotide
cacagggactttgcacatgc

SEQ ID NO: 9168 - DNA, 20 bp, Artificial Sequence
  Description of Artificial Sequence: Synthetic oligonucleotide
acagggactttgcacatgct

SEQ ID NO: 9169 - DNA, 20 bp, Artificial Sequence
  Description of Artificial Sequence: Synthetic oligonucleotide
cagggactttgcacatgctg

SEQ ID NO: 9170 - DNA, 20 bp, Artificial Sequence
  Description of Artificial Sequence: Synthetic oligonucleotide
agggactttgcacatgctgt

SEQ ID NO: 9171 - DNA, 20 bp, Artificial Sequence
  Description of Artificial Sequence: Synthetic oligonucleotide
gggactttgcacatgctgtt

SEQ ID NO: 9172 - DNA, 20 bp, Artificial Sequence
  Description of Artificial Sequence: Synthetic oligonucleotide
ggactttgcacatgctgttc

SEQ ID NO: 9173 - DNA, 20 bp, Artificial Sequence
  Description of Artificial Sequence: Synthetic oligonucleotide
gactttgcacatgctgttcc

SEQ ID NO: 9174 - DNA, 20 bp, Artificial Sequence
  Description of Artificial Sequence: Synthetic oligonucleotide
actttgcacatgctgttccc

SEQ ID NO: 9175 - DNA, 20 bp, Artificial Sequence
  Description of Artificial Sequence: Synthetic oligonucleotide
ctttgcacatgctgttcccc

SEQ ID NO: 9176 - DNA, 20 bp, Artificial Sequence
  Description of Artificial Sequence: Synthetic oligonucleotide
tttgcacatgctgttccccc

SEQ ID NO: 9177 - DNA, 20 bp, Artificial Sequence
  Description of Artificial Sequence: Synthetic oligonucleotide
ttgcacatgctgttccccct

SEQ ID NO: 9178 - DNA, 20 bp, Artificial Sequence
  Description of Artificial Sequence: Synthetic oligonucleotide
tgcacatgctgttccccctg

SEQ ID NO: 9179 - DNA, 20 bp, Artificial Sequence
  Description of Artificial Sequence: Synthetic oligonucleotide
gcacatgctgttccccctgc

SEQ ID NO: 9180 - DNA, 20 bp, Artificial Sequence
  Description of Artificial Sequence: Synthetic oligonucleotide
cacatgctgttccccctgcc

SEQ ID NO: 9181 - DNA, 20 bp, Artificial Sequence
  Description of Artificial Sequence: Synthetic oligonucleotide
acatgctgttccccctgcct

SEQ ID NO: 9182 - DNA, 20 bp, Artificial Sequence
  Description of Artificial Sequence: Synthetic oligonucleotide
catgctgttccccctgcctg

SEQ ID NO: 9183 - DNA, 20 bp, Artificial Sequence
  Description of Artificial Sequence: Synthetic oligonucleotide
atgctgttccccctgcctgg

SEQ ID NO: 9184 - DNA, 20 bp, Artificial Sequence
  Description of Artificial Sequence: Synthetic oligonucleotide
tgctgttccccctgcctggg

SEQ ID NO: 9185 - DNA, 20 bp, Artificial Sequence
  Description of Artificial Sequence: Synthetic oligonucleotide
gctgttccccctgcctggga

SEQ ID NO: 9186 - DNA, 20 bp, Artificial Sequence
  Description of Artificial Sequence: Synthetic oligonucleotide
ctgttccccctgcctgggac

SEQ ID NO: 9187 - DNA, 20 bp, Artificial Sequence
  Description of Artificial Sequence: Synthetic oligonucleotide
tgttccccctgcctgggact

SEQ ID NO: 9188 - DNA, 20 bp, Artificial Sequence
  Description of Artificial Sequence: Synthetic oligonucleotide
gttccccctgcctgggactc

SEQ ID NO: 9189 - DNA, 20 bp, Artificial Sequence
  Description of Artificial Sequence: Synthetic oligonucleotide
ttccccctgcctgggactct

SEQ ID NO: 9190 - DNA, 20 bp, Artificial Sequence
  Description of Artificial Sequence: Synthetic oligonucleotide
tccccctgcctgggactctc

SEQ ID NO: 9191 - DNA, 20 bp, Artificial Sequence
  Description of Artificial Sequence: Synthetic oligonucleotide
ccccctgcctgggactctct

SEQ ID NO: 9192 - DNA, 20 bp, Artificial Sequence
  Description of Artificial Sequence: Synthetic oligonucleotide
cccctgcctgggactctctt

SEQ ID NO: 9193 - DNA, 20 bp, Artificial Sequence
  Description of Artificial Sequence: Synthetic oligonucleotide
ccctgcctgggactctcttt

SEQ ID NO: 9194 - DNA, 20 bp, Artificial Sequence
  Description of Artificial Sequence: Synthetic oligonucleotide
cctgcctgggactctctttt

SEQ ID NO: 9195 - DNA, 20 bp, Artificial Sequence
  Description of Artificial Sequence: Synthetic oligonucleotide
ctgcctgggactctcttttt

SEQ ID NO: 9196 - DNA, 20 bp, Artificial Sequence
  Description of Artificial Sequence: Synthetic oligonucleotide
tgcctgggactctctttttt

SEQ ID NO: 9197 - DNA, 20 bp, Artificial Sequence
  Description of Artificial Sequence: Synthetic oligonucleotide
gcctgggactctcttttttt

SEQ ID NO: 9198 - DNA, 20 bp, Artificial Sequence
  Description of Artificial Sequence: Synthetic oligonucleotide
cctgggactctctttttttg

SEQ ID NO: 9199 - DNA, 20 bp, Artificial Sequence
  Description of Artificial Sequence: Synthetic oligonucleotide
ctgggactctctttttttgt

SEQ ID NO: 9200 - DNA, 20 bp, Artificial Sequence
  Description of Artificial Sequence: Synthetic oligonucleotide
tgggactctctttttttgtt

SEQ ID NO: 9201 - DNA, 20 bp, Artificial Sequence
  Description of Artificial Sequence: Synthetic oligonucleotide
gggactctctttttttgttt

SEQ ID NO: 9202 - DNA, 20 bp, Artificial Sequence
  Description of Artificial Sequence: Synthetic oligonucleotide
ggactctctttttttgtttt

SEQ ID NO: 9203 - DNA, 20 bp, Artificial Sequence
  Description of Artificial Sequence: Synthetic oligonucleotide
gactctctttttttgttttg

SEQ ID NO: 9204 - DNA, 20 bp, Artificial Sequence
  Description of Artificial Sequence: Synthetic oligonucleotide
actctctttttttgttttgt

SEQ ID NO: 9205 - DNA, 20 bp, Artificial Sequence
  Description of Artificial Sequence: Synthetic oligonucleotide
ctctctttttttgttttgtt

SEQ ID NO: 9206 - DNA, 20 bp, Artificial Sequence
  Description of Artificial Sequence: Synthetic oligonucleotide
tctctttttttgttttgttt

SEQ ID NO: 9207 - DNA, 20 bp, Artificial Sequence
  Description of Artificial Sequence: Synthetic oligonucleotide
ctctttttttgttttgtttt

SEQ ID NO: 9208 - DNA, 20 bp, Artificial Sequence
  Description of Artificial Sequence: Synthetic oligonucleotide
tctttttttgttttgttttt

SEQ ID NO: 9209 - DNA, 20 bp, Artificial Sequence
  Description of Artificial Sequence: Synthetic oligonucleotide
ctttttttgttttgtttttt

SEQ ID NO: 9210 - DNA, 20 bp, Artificial Sequence
  Description of Artificial Sequence: Synthetic oligonucleotide
tttttttgttttgttttttg

SEQ ID NO: 9211 - DNA, 20 bp, Artificial Sequence
  Description of Artificial Sequence: Synthetic oligonucleotide
ttttttgttttgttttttga

SEQ ID NO: 9212 - DNA, 20 bp, Artificial Sequence
  Description of Artificial Sequence: Synthetic oligonucleotide
tttttgttttgttttttgat

SEQ ID NO: 9213 - DNA, 20 bp, Artificial Sequence
  Description of Artificial Sequence: Synthetic oligonucleotide
ttttgttttgttttttgata

SEQ ID NO: 9214 - DNA, 20 bp, Artificial Sequence
  Description of Artificial Sequence: Synthetic oligonucleotide
tttgttttgttttttgatac

SEQ ID NO: 9215 - DNA, 20 bp, Artificial Sequence
  Description of Artificial Sequence: Synthetic oligonucleotide
ttgttttgttttttgatacg

SEQ ID NO: 9216 - DNA, 20 bp, Artificial Sequence
  Description of Artificial Sequence: Synthetic oligonucleotide
tgttttgttttttgatacgg

SEQ ID NO: 9217 - DNA, 20 bp, Artificial Sequence
  Description of Artificial Sequence: Synthetic oligonucleotide
gttttgttttttgatacgga

SEQ ID NO: 9218 - DNA, 20 bp, Artificial Sequence
  Description of Artificial Sequence: Synthetic oligonucleotide
ttttgttttttgatacggag

SEQ ID NO: 9219 - DNA, 20 bp, Artificial Sequence
  Description of Artificial Sequence: Synthetic oligonucleotide
tttgttttttgatacggagt

SEQ ID NO: 9220 - DNA, 20 bp, Artificial Sequence
  Description of Artificial Sequence: Synthetic oligonucleotide
ttgttttttgatacggagtc

SEQ ID NO: 9221 - DNA, 20 bp, Artificial Sequence
  Description of Artificial Sequence: Synthetic oligonucleotide
tgttttttgatacggagtct

SEQ ID NO: 9222 - DNA, 20 bp, Artificial Sequence
  Description of Artificial Sequence: Synthetic oligonucleotide
gttttttgatacggagtctc

SEQ ID NO: 9223 - DNA, 20 bp, Artificial Sequence
  Description of Artificial Sequence: Synthetic oligonucleotide
ttttttgatacggagtctcg

SEQ ID NO: 9224 - DNA, 20 bp, Artificial Sequence
  Description of Artificial Sequence: Synthetic oligonucleotide
tttttgatacggagtctcgc

SEQ ID NO: 9225 - DNA, 20 bp, Artificial Sequence
  Description of Artificial Sequence: Synthetic oligonucleotide
ttttgatacggagtctcgct

SEQ ID NO: 9226 - DNA, 20 bp, Artificial Sequence
  Description of Artificial Sequence: Synthetic oligonucleotide
tttgatacggagtctcgctc

SEQ ID NO: 9227 - DNA, 20 bp, Artificial Sequence
  Description of Artificial Sequence: Synthetic oligonucleotide
ttgatacggagtctcgctct

SEQ ID NO: 9228 - DNA, 20 bp, Artificial Sequence
  Description of Artificial Sequence: Synthetic oligonucleotide
tgatacggagtctcgctctg

SEQ ID NO: 9229 - DNA, 20 bp, Artificial Sequence
  Description of Artificial Sequence: Synthetic oligonucleotide
gatacggagtctcgctctgt

SEQ ID NO: 9230 - DNA, 20 bp, Artificial Sequence
  Description of Artificial Sequence: Synthetic oligonucleotide
atacggagtctcgctctgtc

SEQ ID NO: 9231 - DNA, 20 bp, Artificial Sequence
  Description of Artificial Sequence: Synthetic oligonucleotide
tacggagtctcgctctgtcg

SEQ ID NO: 9232 - DNA, 20 bp, Artificial Sequence
  Description of Artificial Sequence: Synthetic oligonucleotide
acggagtctcgctctgtcgc

SEQ ID NO: 9233 - DNA, 20 bp, Artificial Sequence
  Description of Artificial Sequence: Synthetic oligonucleotide
cggagtctcgctctgtcgcc

SEQ ID NO: 9234 - DNA, 20 bp, Artificial Sequence
  Description of Artificial Sequence: Synthetic oligonucleotide
ggagtctcgctctgtcgcca

SEQ ID NO: 9235 - DNA, 20 bp, Artificial Sequence
  Description of Artificial Sequence: Synthetic oligonucleotide
gagtctcgctctgtcgccag

SEQ ID NO: 9236 - DNA, 20 bp, Artificial Sequence
  Description of Artificial Sequence: Synthetic oligonucleotide
agtctcgctctgtcgccagg

SEQ ID NO: 9237 - DNA, 20 bp, Artificial Sequence
  Description of Artificial Sequence: Synthetic oligonucleotide
gtctcgctctgtcgccaggc

SEQ ID NO: 9238 - DNA, 20 bp, Artificial Sequence
  Description of Artificial Sequence: Synthetic oligonucleotide
tctcgctctgtcgccaggct

SEQ ID NO: 9239 - DNA, 20 bp, Artificial Sequence
  Description of Artificial Sequence: Synthetic oligonucleotide
ctcgctctgtcgccaggctg

SEQ ID NO: 9240 - DNA, 20 bp, Artificial Sequence
  Description of Artificial Sequence: Synthetic oligonucleotide
tcgctctgtcgccaggctgg

SEQ ID NO: 9241 - DNA, 20 bp, Artificial Sequence
  Description of Artificial Sequence: Synthetic oligonucleotide
cgctctgtcgccaggctgga

SEQ ID NO: 9242 - DNA, 20 bp, Artificial Sequence
  Description of Artificial Sequence: Synthetic oligonucleotide
gctctgtcgccaggctggag

SEQ ID NO: 9243 - DNA, 20 bp, Artificial Sequence
  Description of Artificial Sequence: Synthetic oligonucleotide
ctctgtcgccaggctggagt

SEQ ID NO: 9244 - DNA, 20 bp, Artificial Sequence
  Description of Artificial Sequence: Synthetic oligonucleotide
tctgtcgccaggctggagtg

SEQ ID NO: 9245 - DNA, 20 bp, Artificial Sequence
  Description of Artificial Sequence: Synthetic oligonucleotide
ctgtcgccaggctggagtgc

SEQ ID NO: 9246 - DNA, 20 bp, Artificial Sequence
  Description of Artificial Sequence: Synthetic oligonucleotide
tgtcgccaggctggagtgca

SEQ ID NO: 9247 - DNA, 20 bp, Artificial Sequence
  Description of Artificial Sequence: Synthetic oligonucleotide
gtcgccaggctggagtgcag

SEQ ID NO: 9248 - DNA, 20 bp, Artificial Sequence
  Description of Artificial Sequence: Synthetic oligonucleotide
tcgccaggctggagtgcagt

SEQ ID NO: 9249 - DNA, 20 bp, Artificial Sequence
  Description of Artificial Sequence: Synthetic oligonucleotide
cgccaggctggagtgcagtg

SEQ ID NO: 9250 - DNA, 20 bp, Artificial Sequence
  Description of Artificial Sequence: Synthetic oligonucleotide
gccaggctggagtgcagtgg

SEQ ID NO: 9251 - DNA, 20 bp, Artificial Sequence
  Description of Artificial Sequence: Synthetic oligonucleotide
ccaggctggagtgcagtggc

SEQ ID NO: 9252 - DNA, 20 bp, Artificial Sequence
  Description of Artificial Sequence: Synthetic oligonucleotide
caggctggagtgcagtggcg

SEQ ID NO: 9253 - DNA, 20 bp, Artificial Sequence
  Description of Artificial Sequence: Synthetic oligonucleotide
aggctggagtgcagtggcgc

SEQ ID NO: 9254 - DNA, 20 bp, Artificial Sequence
  Description of Artificial Sequence: Synthetic oligonucleotide
ggctggagtgcagtggcgca

SEQ ID NO: 9255 - DNA, 20 bp, Artificial Sequence
  Description of Artificial Sequence: Synthetic oligonucleotide
gctggagtgcagtggcgcaa

SEQ ID NO: 9256 - DNA, 20 bp, Artificial Sequence
  Description of Artificial Sequence: Synthetic oligonucleotide
ctggagtgcagtggcgcaat

SEQ ID NO: 9257 - DNA, 20 bp, Artificial Sequence
  Description of Artificial Sequence: Synthetic oligonucleotide
tggagtgcagtggcgcaatc

SEQ ID NO: 9258 - DNA, 20 bp, Artificial Sequence
  Description of Artificial Sequence: Synthetic oligonucleotide
ggagtgcagtggcgcaatct

SEQ ID NO: 9259 - DNA, 20 bp, Artificial Sequence
  Description of Artificial Sequence: Synthetic oligonucleotide
gagtgcagtggcgcaatctt

SEQ ID NO: 9260 - DNA, 20 bp, Artificial Sequence
  Description of Artificial Sequence: Synthetic oligonucleotide
agtgcagtggcgcaatcttg

SEQ ID NO: 9261 - DNA, 20 bp, Artificial Sequence
  Description of Artificial Sequence: Synthetic oligonucleotide
gtgcagtggcgcaatcttgg

SEQ ID NO: 9262 - DNA, 20 bp, Artificial Sequence
  Description of Artificial Sequence: Synthetic oligonucleotide
tgcagtggcgcaatcttggc

SEQ ID NO: 9263 - DNA, 20 bp, Artificial Sequence
  Description of Artificial Sequence: Synthetic oligonucleotide
gcagtggcgcaatcttggct

SEQ ID NO: 9264 - DNA, 20 bp, Artificial Sequence
  Description of Artificial Sequence: Synthetic oligonucleotide
cagtggcgcaatcttggctc

SEQ ID NO: 9265 - DNA, 20 bp, Artificial Sequence
  Description of Artificial Sequence: Synthetic oligonucleotide
agtggcgcaatcttggctca

SEQ ID NO: 9266 - DNA, 20 bp, Artificial Sequence
  Description of Artificial Sequence: Synthetic oligonucleotide
gtggcgcaatcttggctcac

SEQ ID NO: 9267 - DNA, 20 bp, Artificial Sequence
  Description of Artificial Sequence: Synthetic oligonucleotide
tggcgcaatcttggctcact

SEQ ID NO: 9268 - DNA, 20 bp, Artificial Sequence
  Description of Artificial Sequence: Synthetic oligonucleotide
ggcgcaatcttggctcactg

SEQ ID NO: 9269 - DNA, 20 bp, Artificial Sequence
  Description of Artificial Sequence: Synthetic oligonucleotide
gcgcaatcttggctcactgc

SEQ ID NO: 9270 - DNA, 20 bp, Artificial Sequence
  Description of Artificial Sequence: Synthetic oligonucleotide
cgcaatcttggctcactgca

SEQ ID NO: 9271 - DNA, 20 bp, Artificial Sequence
  Description of Artificial Sequence: Synthetic oligonucleotide
gcaatcttggctcactgcaa

SEQ ID NO: 9272 - DNA, 20 bp, Artificial Sequence
  Description of Artificial Sequence: Synthetic oligonucleotide
caatcttggctcactgcaac

SEQ ID NO: 9273 - DNA, 20 bp, Artificial Sequence
  Description of Artificial Sequence: Synthetic oligonucleotide
aatcttggctcactgcaacc

SEQ ID NO: 9274 - DNA, 20 bp, Artificial Sequence
  Description of Artificial Sequence: Synthetic oligonucleotide
atcttggctcactgcaacct

SEQ ID NO: 9275 - DNA, 20 bp, Artificial Sequence
  Description of Artificial Sequence: Synthetic oligonucleotide
tcttggctcactgcaacctc

SEQ ID NO: 9276 - DNA, 20 bp, Artificial Sequence
  Description of Artificial Sequence: Synthetic oligonucleotide
cttggctcactgcaacctcc

SEQ ID NO: 9277 - DNA, 20 bp, Artificial Sequence
  Description of Artificial Sequence: Synthetic oligonucleotide
ttggctcactgcaacctccg

SEQ ID NO: 9278 - DNA, 20 bp, Artificial Sequence
  Description of Artificial Sequence: Synthetic oligonucleotide
tggctcactgcaacctccgc

SEQ ID NO: 9279 - DNA, 20 bp, Artificial Sequence
  Description of Artificial Sequence: Synthetic oligonucleotide
ggctcactgcaacctccgcc

SEQ ID NO: 9280 - DNA, 20 bp, Artificial Sequence
  Description of Artificial Sequence: Synthetic oligonucleotide
gctcactgcaacctccgcct

SEQ ID NO: 9281 - DNA, 20 bp, Artificial Sequence
  Description of Artificial Sequence: Synthetic oligonucleotide
ctcactgcaacctccgcctc

SEQ ID NO: 9282 - DNA, 20 bp, Artificial Sequence
  Description of Artificial Sequence: Synthetic oligonucleotide
tcactgcaacctccgcctcc

SEQ ID NO: 9283 - DNA, 20 bp, Artificial Sequence
  Description of Artificial Sequence: Synthetic oligonucleotide
cactgcaacctccgcctccc

SEQ ID NO: 9284 - DNA, 20 bp, Artificial Sequence
  Description of Artificial Sequence: Synthetic oligonucleotide
actgcaacctccgcctccca

SEQ ID NO: 9285 - DNA, 20 bp, Artificial Sequence
  Description of Artificial Sequence: Synthetic oligonucleotide
ctgcaacctccgcctcccag

SEQ ID NO: 9286 - DNA, 20 bp, Artificial Sequence
  Description of Artificial Sequence: Synthetic oligonucleotide
tgcaacctccgcctcccagg

SEQ ID NO: 9287 - DNA, 20 bp, Artificial Sequence
  Description of Artificial Sequence: Synthetic oligonucleotide
gcaacctccgcctcccaggt

SEQ ID NO: 9288 - DNA, 20 bp, Artificial Sequence
  Description of Artificial Sequence: Synthetic oligonucleotide
caacctccgcctcccaggtt

SEQ ID NO: 9289 - DNA, 20 bp, Artificial Sequence
  Description of Artificial Sequence: Synthetic oligonucleotide
aacctccgcctcccaggttc

SEQ ID NO: 9290 - DNA, 20 bp, Artificial Sequence
  Description of Artificial Sequence: Synthetic oligonucleotide
acctccgcctcccaggttca

SEQ ID NO: 9291 - DNA, 20 bp, Artificial Sequence
  Description of Artificial Sequence: Synthetic oligonucleotide
cctccgcctcccaggttcaa

SEQ ID NO: 9292 - DNA, 20 bp, Artificial Sequence
  Description of Artificial Sequence: Synthetic oligonucleotide
ctccgcctcccaggttcaag

SEQ ID NO: 9293 - DNA, 20 bp, Artificial Sequence
  Description of Artificial Sequence: Synthetic oligonucleotide
tccgcctcccaggttcaagc

SEQ ID NO: 9294 - DNA, 20 bp, Artificial Sequence
  Description of Artificial Sequence: Synthetic oligonucleotide
ccgcctcccaggttcaagca

SEQ ID NO: 9295 - DNA, 20 bp, Artificial Sequence
  Description of Artificial Sequence: Synthetic oligonucleotide
cgcctcccaggttcaagcaa

SEQ ID NO: 9296 - DNA, 20 bp, Artificial Sequence
  Description of Artificial Sequence: Synthetic oligonucleotide
gcctcccaggttcaagcaat

SEQ ID NO: 9297 - DNA, 20 bp, Artificial Sequence
  Description of Artificial Sequence: Synthetic oligonucleotide
cctcccaggttcaagcaatt

SEQ ID NO: 9298 - DNA, 20 bp, Artificial Sequence
  Description of Artificial Sequence: Synthetic oligonucleotide
ctcccaggttcaagcaattc

SEQ ID NO: 9299 - DNA, 20 bp, Artificial Sequence
  Description of Artificial Sequence: Synthetic oligonucleotide
tcccaggttcaagcaattct

SEQ ID NO: 9300 - DNA, 20 bp, Artificial Sequence
  Description of Artificial Sequence: Synthetic oligonucleotide
cccaggttcaagcaattctg

SEQ ID NO: 9301 - DNA, 20 bp, Artificial Sequence
  Description of Artificial Sequence: Synthetic oligonucleotide
ccaggttcaagcaattctgc

SEQ ID NO: 9302 - DNA, 20 bp, Artificial Sequence
  Description of Artificial Sequence: Synthetic oligonucleotide
caggttcaagcaattctgcc

SEQ ID NO: 9303 - DNA, 20 bp, Artificial Sequence
  Description of Artificial Sequence: Synthetic oligonucleotide
aggttcaagcaattctgccg

SEQ ID NO: 9304 - DNA, 20 bp, Artificial Sequence
  Description of Artificial Sequence: Synthetic oligonucleotide
ggttcaagcaattctgccgc

SEQ ID NO: 9305 - DNA, 20 bp, Artificial Sequence
  Description of Artificial Sequence: Synthetic oligonucleotide
gttcaagcaattctgccgca

SEQ ID NO: 9306 - DNA, 20 bp, Artificial Sequence
  Description of Artificial Sequence: Synthetic oligonucleotide
ttcaagcaattctgccgcag

SEQ ID NO: 9307 - DNA, 20 bp, Artificial Sequence
  Description of Artificial Sequence: Synthetic oligonucleotide
tcaagcaattctgccgcagc

SEQ ID NO: 9308 - DNA, 20 bp, Artificial Sequence
  Description of Artificial Sequence: Synthetic oligonucleotide
caagcaattctgccgcagcc

SEQ ID NO: 9309 - DNA, 20 bp, Artificial Sequence
  Description of Artificial Sequence: Synthetic oligonucleotide
aagcaattctgccgcagcct

SEQ ID NO: 9310 - DNA, 20 bp, Artificial Sequence
  Description of Artificial Sequence: Synthetic oligonucleotide
agcaattctgccgcagcctc

SEQ ID NO: 9311 - DNA, 20 bp, Artificial Sequence
  Description of Artificial Sequence: Synthetic oligonucleotide
gcaattctgccgcagcctcc

SEQ ID NO: 9312 - DNA, 20 bp, Artificial Sequence
  Description of Artificial Sequence: Synthetic oligonucleotide
caattctgccgcagcctccg

SEQ ID NO: 9313 - DNA, 20 bp, Artificial Sequence
  Description of Artificial Sequence: Synthetic oligonucleotide
aattctgccgcagcctccgg

SEQ ID NO: 9314 - DNA, 20 bp, Artificial Sequence
  Description of Artificial Sequence: Synthetic oligonucleotide
attctgccgcagcctccgga

SEQ ID NO: 9315 - DNA, 20 bp, Artificial Sequence
  Description of Artificial Sequence: Synthetic oligonucleotide
ttctgccgcagcctccggag

SEQ ID NO: 9316 - DNA, 20 bp, Artificial Sequence
  Description of Artificial Sequence: Synthetic oligonucleotide
tctgccgcagcctccggagc

SEQ ID NO: 9317 - DNA, 20 bp, Artificial Sequence
  Description of Artificial Sequence: Synthetic oligonucleotide
ctgccgcagcctccggagca

SEQ ID NO: 9318 - DNA, 20 bp, Artificial Sequence
  Description of Artificial Sequence: Synthetic oligonucleotide
tgccgcagcctccggagcag

SEQ ID NO: 9319 - DNA, 20 bp, Artificial Sequence
  Description of Artificial Sequence: Synthetic oligonucleotide
gccgcagcctccggagcagc

SEQ ID NO: 9320 - DNA, 20 bp, Artificial Sequence
  Description of Artificial Sequence: Synthetic oligonucleotide
ccgcagcctccggagcagct

SEQ ID NO: 9321 - DNA, 20 bp, Artificial Sequence
  Description of Artificial Sequence: Synthetic oligonucleotide
cgcagcctccggagcagctg

SEQ ID NO: 9322 - DNA, 20 bp, Artificial Sequence
  Description of Artificial Sequence: Synthetic oligonucleotide
gcagcctccggagcagctgg

SEQ ID NO: 9323 - DNA, 20 bp, Artificial Sequence
  Description of Artificial Sequence: Synthetic oligonucleotide
cagcctccggagcagctggg

SEQ ID NO: 9324 - DNA, 20 bp, Artificial Sequence
  Description of Artificial Sequence: Synthetic oligonucleotide
agcctccggagcagctggga

SEQ ID NO: 9325 - DNA, 20 bp, Artificial Sequence
  Description of Artificial Sequence: Synthetic oligonucleotide
gcctccggagcagctgggac

SEQ ID NO: 9326 - DNA, 20 bp, Artificial Sequence
  Description of Artificial Sequence: Synthetic oligonucleotide
cctccggagcagctgggact

SEQ ID NO: 9327 - DNA, 20 bp, Artificial Sequence
  Description of Artificial Sequence: Synthetic oligonucleotide
ctccggagcagctgggacta

SEQ ID NO: 9328 - DNA, 20 bp, Artificial Sequence
  Description of Artificial Sequence: Synthetic oligonucleotide
tccggagcagctgggactac

SEQ ID NO: 9329 - DNA, 20 bp, Artificial Sequence
  Description of Artificial Sequence: Synthetic oligonucleotide
ccggagcagctgggactaca

SEQ ID NO: 9330 - DNA, 20 bp, Artificial Sequence
  Description of Artificial Sequence: Synthetic oligonucleotide
cggagcagctgggactacag

SEQ ID NO: 9331 - DNA, 20 bp, Artificial Sequence
  Description of Artificial Sequence: Synthetic oligonucleotide
ggagcagctgggactacagg

SEQ ID NO: 9332 - DNA, 20 bp, Artificial Sequence
  Description of Artificial Sequence: Synthetic oligonucleotide
gagcagctgggactacaggc

SEQ ID NO: 9333 - DNA, 20 bp, Artificial Sequence
  Description of Artificial Sequence: Synthetic oligonucleotide
agcagctgggactacaggca

SEQ ID NO: 9334 - DNA, 20 bp, Artificial Sequence
  Description of Artificial Sequence: Synthetic oligonucleotide
gcagctgggactacaggcat

SEQ ID NO: 9335 - DNA, 20 bp, Artificial Sequence
  Description of Artificial Sequence: Synthetic oligonucleotide
cagctgggactacaggcatg

SEQ ID NO: 9336 - DNA, 20 bp, Artificial Sequence
  Description of Artificial Sequence: Synthetic oligonucleotide
agctgggactacaggcatgt

SEQ ID NO: 9337 - DNA, 20 bp, Artificial Sequence
  Description of Artificial Sequence: Synthetic oligonucleotide
gctgggactacaggcatgtg

SEQ ID NO: 9338 - DNA, 20 bp, Artificial Sequence
  Description of Artificial Sequence: Synthetic oligonucleotide
ctgggactacaggcatgtgc

SEQ ID NO: 9339 - DNA, 20 bp, Artificial Sequence
  Description of Artificial Sequence: Synthetic oligonucleotide
tgggactacaggcatgtgcc

SEQ ID NO: 9340 - DNA, 20 bp, Artificial Sequence
  Description of Artificial Sequence: Synthetic oligonucleotide
gggactacaggcatgtgcca

SEQ ID NO: 9341 - DNA, 20 bp, Artificial Sequence
  Description of Artificial Sequence: Synthetic oligonucleotide
ggactacaggcatgtgccac

SEQ ID NO: 9342 - DNA, 20 bp, Artificial Sequence
  Description of Artificial Sequence: Synthetic oligonucleotide
gactacaggcatgtgccacc

SEQ ID NO: 9343 - DNA, 20 bp, Artificial Sequence
  Description of Artificial Sequence: Synthetic oligonucleotide
actacaggcatgtgccacca

SEQ ID NO: 9344 - DNA, 20 bp, Artificial Sequence
  Description of Artificial Sequence: Synthetic oligonucleotide
ctacaggcatgtgccaccac

SEQ ID NO: 9345 - DNA, 20 bp, Artificial Sequence
  Description of Artificial Sequence: Synthetic oligonucleotide
tacaggcatgtgccaccacg

SEQ ID NO: 9346 - DNA, 20 bp, Artificial Sequence
  Description of Artificial Sequence: Synthetic oligonucleotide
acaggcatgtgccaccacgc

SEQ ID NO: 9347 - DNA, 20 bp, Artificial Sequence
  Description of Artificial Sequence: Synthetic oligonucleotide
caggcatgtgccaccacgcc

SEQ ID NO: 9348 - DNA, 20 bp, Artificial Sequence
  Description of Artificial Sequence: Synthetic oligonucleotide
aggcatgtgccaccacgccc

SEQ ID NO: 9349 - DNA, 20 bp, Artificial Sequence
  Description of Artificial Sequence: Synthetic oligonucleotide
ggcatgtgccaccacgcccg

SEQ ID NO: 9350 - DNA, 20 bp, Artificial Sequence
  Description of Artificial Sequence: Synthetic oligonucleotide
gcatgtgccaccacgcccga

SEQ ID NO: 9351 - DNA, 20 bp, Artificial Sequence
  Description of Artificial Sequence: Synthetic oligonucleotide
catgtgccaccacgcccgac

SEQ ID NO: 9352 - DNA, 20 bp, Artificial Sequence
  Description of Artificial Sequence: Synthetic oligonucleotide
atgtgccaccacgcccgact

SEQ ID NO: 9353 - DNA, 20 bp, Artificial Sequence
  Description of Artificial Sequence: Synthetic oligonucleotide
tgtgccaccacgcccgacta

SEQ ID NO: 9354 - DNA, 20 bp, Artificial Sequence
  Description of Artificial Sequence: Synthetic oligonucleotide
gtgccaccacgcccgactag

SEQ ID NO: 9355 - DNA, 20 bp, Artificial Sequence
  Description of Artificial Sequence: Synthetic oligonucleotide
tgccaccacgcccgactagt

SEQ ID NO: 9356 - DNA, 20 bp, Artificial Sequence
  Description of Artificial Sequence: Synthetic oligonucleotide
gccaccacgcccgactagtt

SEQ ID NO: 9357 - DNA, 20 bp, Artificial Sequence
  Description of Artificial Sequence: Synthetic oligonucleotide
ccaccacgcccgactagttt

SEQ ID NO: 9358 - DNA, 20 bp, Artificial Sequence
  Description of Artificial Sequence: Synthetic oligonucleotide
caccacgcccgactagtttt

SEQ ID NO: 9359 - DNA, 20 bp, Artificial Sequence
  Description of Artificial Sequence: Synthetic oligonucleotide
accacgcccgactagttttt

SEQ ID NO: 9360 - DNA, 20 bp, Artificial Sequence
  Description of Artificial Sequence: Synthetic oligonucleotide
ccacgcccgactagtttttg

SEQ ID NO: 9361 - DNA, 20 bp, Artificial Sequence
  Description of Artificial Sequence: Synthetic oligonucleotide
cacgcccgactagtttttgc

SEQ ID NO: 9362 - DNA, 20 bp, Artificial Sequence
  Description of Artificial Sequence: Synthetic oligonucleotide
acgcccgactagtttttgca

SEQ ID NO: 9363 - DNA, 20 bp, Artificial Sequence
  Description of Artificial Sequence: Synthetic oligonucleotide
cgcccgactagtttttgcat

SEQ ID NO: 9364 - DNA, 20 bp, Artificial Sequence
  Description of Artificial Sequence: Synthetic oligonucleotide
gcccgactagtttttgcatt

SEQ ID NO: 9365 - DNA, 20 bp, Artificial Sequence
  Description of Artificial Sequence: Synthetic oligonucleotide
cccgactagtttttgcatta

SEQ ID NO: 9366 - DNA, 20 bp, Artificial Sequence
  Description of Artificial Sequence: Synthetic oligonucleotide
ccgactagtttttgcattat

SEQ ID NO: 9367 - DNA, 20 bp, Artificial Sequence
  Description of Artificial Sequence: Synthetic oligonucleotide
cgactagtttttgcattatt

SEQ ID NO: 9368 - DNA, 20 bp, Artificial Sequence
  Description of Artificial Sequence: Synthetic oligonucleotide
gactagtttttgcattattt

SEQ ID NO: 9369 - DNA, 20 bp, Artificial Sequence
  Description of Artificial Sequence: Synthetic oligonucleotide
actagtttttgcattatttg

SEQ ID NO: 9370 - DNA, 20 bp, Artificial Sequence
  Description of Artificial Sequence: Synthetic oligonucleotide
ctagtttttgcattatttgt

SEQ ID NO: 9371 - DNA, 20 bp, Artificial Sequence
  Description of Artificial Sequence: Synthetic oligonucleotide
tagtttttgcattatttgta

SEQ ID NO: 9372 - DNA, 20 bp, Artificial Sequence
  Description of Artificial Sequence: Synthetic oligonucleotide
agtttttgcattatttgtag

SEQ ID NO: 9373 - DNA, 20 bp, Artificial Sequence
  Description of Artificial Sequence: Synthetic oligonucleotide
gtttttgcattatttgtaga

SEQ ID NO: 9374 - DNA, 20 bp, Artificial Sequence
  Description of Artificial Sequence: Synthetic oligonucleotide
tttttgcattatttgtagag

SEQ ID NO: 9375 - DNA, 20 bp, Artificial Sequence
  Description of Artificial Sequence: Synthetic oligonucleotide
ttttgcattatttgtagaga

SEQ ID NO: 9376 - DNA, 20 bp, Artificial Sequence
  Description of Artificial Sequence: Synthetic oligonucleotide
tttgcattatttgtagagac

SEQ ID NO: 9377 - DNA, 20 bp, Artificial Sequence
  Description of Artificial Sequence: Synthetic oligonucleotide
ttgcattatttgtagagacg

SEQ ID NO: 9378 - DNA, 20 bp, Artificial Sequence
  Description of Artificial Sequence: Synthetic oligonucleotide
tgcattatttgtagagacgg

SEQ ID NO: 9379 - DNA, 20 bp, Artificial Sequence
  Description of Artificial Sequence: Synthetic oligonucleotide
gcattatttgtagagacggg

SEQ ID NO: 9380 - DNA, 20 bp, Artificial Sequence
  Description of Artificial Sequence: Synthetic oligonucleotide
cattatttgtagagacgggg

SEQ ID NO: 9381 - DNA, 20 bp, Artificial Sequence
  Description of Artificial Sequence: Synthetic oligonucleotide
attatttgtagagacggggg

SEQ ID NO: 9382 - DNA, 20 bp, Artificial Sequence
  Description of Artificial Sequence: Synthetic oligonucleotide
ttatttgtagagacgggggt

SEQ ID NO: 9383 - DNA, 20 bp, Artificial Sequence
  Description of Artificial Sequence: Synthetic oligonucleotide
tatttgtagagacgggggtt

SEQ ID NO: 9384 - DNA, 20 bp, Artificial Sequence
  Description of Artificial Sequence: Synthetic oligonucleotide
atttgtagagacgggggttt

SEQ ID NO: 9385 - DNA, 20 bp, Artificial Sequence
  Description of Artificial Sequence: Synthetic oligonucleotide
tttgtagagacgggggtttc

SEQ ID NO: 9386 - DNA, 20 bp, Artificial Sequence
  Description of Artificial Sequence: Synthetic oligonucleotide
ttgtagagacgggggtttca

SEQ ID NO: 9387 - DNA, 20 bp, Artificial Sequence
  Description of Artificial Sequence: Synthetic oligonucleotide
tgtagagacgggggtttcac

SEQ ID NO: 9388 - DNA, 20 bp, Artificial Sequence
  Description of Artificial Sequence: Synthetic oligonucleotide
gtagagacgggggtttcacc

SEQ ID NO: 9389 - DNA, 20 bp, Artificial Sequence
  Description of Artificial Sequence: Synthetic oligonucleotide
tagagacgggggtttcacca

SEQ ID NO: 9390 - DNA, 20 bp, Artificial Sequence
  Description of Artificial Sequence: Synthetic oligonucleotide
agagacgggggtttcaccat

SEQ ID NO: 9391 - DNA, 20 bp, Artificial Sequence
  Description of Artificial Sequence: Synthetic oligonucleotide
gagacgggggtttcaccatg

SEQ ID NO: 9392 - DNA, 20 bp, Artificial Sequence
  Description of Artificial Sequence: Synthetic oligonucleotide
agacgggggtttcaccatgt

SEQ ID NO: 9393 - DNA, 20 bp, Artificial Sequence
  Description of Artificial Sequence: Synthetic oligonucleotide
gacgggggtttcaccatgtt

SEQ ID NO: 9394 - DNA, 20 bp, Artificial Sequence
  Description of Artificial Sequence: Synthetic oligonucleotide
acgggggtttcaccatgttg

SEQ ID NO: 9395 - DNA, 20 bp, Artificial Sequence
  Description of Artificial Sequence: Synthetic oligonucleotide
cgggggtttcaccatgttgg

SEQ ID NO: 9396 - DNA, 20 bp, Artificial Sequence
  Description of Artificial Sequence: Synthetic oligonucleotide
gggggtttcaccatgttggc

SEQ ID NO: 9397 - DNA, 20 bp, Artificial Sequence
  Description of Artificial Sequence: Synthetic oligonucleotide
ggggtttcaccatgttggcc

SEQ ID NO: 9398 - DNA, 20 bp, Artificial Sequence
  Description of Artificial Sequence: Synthetic oligonucleotide
gggtttcaccatgttggcca

SEQ ID NO: 9399 - DNA, 20 bp, Artificial Sequence
  Description of Artificial Sequence: Synthetic oligonucleotide
ggtttcaccatgttggccag

SEQ ID NO: 9400 - DNA, 20 bp, Artificial Sequence
  Description of Artificial Sequence: Synthetic oligonucleotide
gtttcaccatgttggccaga

SEQ ID NO: 9401 - DNA, 20 bp, Artificial Sequence
  Description of Artificial Sequence: Synthetic oligonucleotide
tttcaccatgttggccagac

SEQ ID NO: 9402 - DNA, 20 bp, Artificial Sequence
  Description of Artificial Sequence: Synthetic oligonucleotide
ttcaccatgttggccagact

SEQ ID NO: 9403 - DNA, 20 bp, Artificial Sequence
  Description of Artificial Sequence: Synthetic oligonucleotide
tcaccatgttggccagactg

SEQ ID NO: 9404 - DNA, 20 bp, Artificial Sequence
  Description of Artificial Sequence: Synthetic oligonucleotide
caccatgttggccagactgg

SEQ ID NO: 9405 - DNA, 20 bp, Artificial Sequence
  Description of Artificial Sequence: Synthetic oligonucleotide
accatgttggccagactggt

SEQ ID NO: 9406 - DNA, 20 bp, Artificial Sequence
  Description of Artificial Sequence: Synthetic oligonucleotide
ccatgttggccagactggtc

SEQ ID NO: 9407 - DNA, 20 bp, Artificial Sequence
  Description of Artificial Sequence: Synthetic oligonucleotide
catgttggccagactggtct

SEQ ID NO: 9408 - DNA, 20 bp, Artificial Sequence
  Description of Artificial Sequence: Synthetic oligonucleotide
atgttggccagactggtctc

SEQ ID NO: 9409 - DNA, 20 bp, Artificial Sequence
  Description of Artificial Sequence: Synthetic oligonucleotide
tgttggccagactggtctcg

SEQ ID NO: 9410 - DNA, 20 bp, Artificial Sequence
  Description of Artificial Sequence: Synthetic oligonucleotide
gttggccagactggtctcga

SEQ ID NO: 9411 - DNA, 20 bp, Artificial Sequence
  Description of Artificial Sequence: Synthetic oligonucleotide
ttggccagactggtctcgat

SEQ ID NO: 9412 - DNA, 20 bp, Artificial Sequence
  Description of Artificial Sequence: Synthetic oligonucleotide
tggccagactggtctcgatc

SEQ ID NO: 9413 - DNA, 20 bp, Artificial Sequence
  Description of Artificial Sequence: Synthetic oligonucleotide
ggccagactggtctcgatct

SEQ ID NO: 9414 - DNA, 20 bp, Artificial Sequence
  Description of Artificial Sequence: Synthetic oligonucleotide
gccagactggtctcgatctc

SEQ ID NO: 9415 - DNA, 20 bp, Artificial Sequence
  Description of Artificial Sequence: Synthetic oligonucleotide
ccagactggtctcgatctcc

SEQ ID NO: 9416 - DNA, 20 bp, Artificial Sequence
  Description of Artificial Sequence: Synthetic oligonucleotide
cagactggtctcgatctcct

SEQ ID NO: 9417 - DNA, 20 bp, Artificial Sequence
  Description of Artificial Sequence: Synthetic oligonucleotide
agactggtctcgatctcctg

SEQ ID NO: 9418 - DNA, 20 bp, Artificial Sequence
  Description of Artificial Sequence: Synthetic oligonucleotide
gactggtctcgatctcctga

SEQ ID NO: 9419 - DNA, 20 bp, Artificial Sequence
  Description of Artificial Sequence: Synthetic oligonucleotide
actggtctcgatctcctgac

SEQ ID NO: 9420 - DNA, 20 bp, Artificial Sequence
  Description of Artificial Sequence: Synthetic oligonucleotide
ctggtctcgatctcctgacc

SEQ ID NO: 9421 - DNA, 20 bp, Artificial Sequence
  Description of Artificial Sequence: Synthetic oligonucleotide
tggtctcgatctcctgacct

SEQ ID NO: 9422 - DNA, 20 bp, Artificial Sequence
  Description of Artificial Sequence: Synthetic oligonucleotide
ggtctcgatctcctgacctc

SEQ ID NO: 9423 - DNA, 20 bp, Artificial Sequence
  Description of Artificial Sequence: Synthetic oligonucleotide
gtctcgatctcctgacctcg

SEQ ID NO: 9424 - DNA, 20 bp, Artificial Sequence
  Description of Artificial Sequence: Synthetic oligonucleotide
tctcgatctcctgacctcgt

SEQ ID NO: 9425 - DNA, 20 bp, Artificial Sequence
  Description of Artificial Sequence: Synthetic oligonucleotide
ctcgatctcctgacctcgtg

SEQ ID NO: 9426 - DNA, 20 bp, Artificial Sequence
  Description of Artificial Sequence: Synthetic oligonucleotide
tcgatctcctgacctcgtga

SEQ ID NO: 9427 - DNA, 20 bp, Artificial Sequence
  Description of Artificial Sequence: Synthetic oligonucleotide
cgatctcctgacctcgtgat

SEQ ID NO: 9428 - DNA, 20 bp, Artificial Sequence
  Description of Artificial Sequence: Synthetic oligonucleotide
gatctcctgacctcgtgatc

SEQ ID NO: 9429 - DNA, 20 bp, Artificial Sequence
  Description of Artificial Sequence: Synthetic oligonucleotide
atctcctgacctcgtgatcc

SEQ ID NO: 9430 - DNA, 20 bp, Artificial Sequence
  Description of Artificial Sequence: Synthetic oligonucleotide
tctcctgacctcgtgatccg

SEQ ID NO: 9431 - DNA, 20 bp, Artificial Sequence
  Description of Artificial Sequence: Synthetic oligonucleotide
ctcctgacctcgtgatccgc

SEQ ID NO: 9432 - DNA, 20 bp, Artificial Sequence
  Description of Artificial Sequence: Synthetic oligonucleotide
tcctgacctcgtgatccgcc

SEQ ID NO: 9433 - DNA, 20 bp, Artificial Sequence
  Description of Artificial Sequence: Synthetic oligonucleotide
cctgacctcgtgatccgcca

SEQ ID NO: 9434 - DNA, 20 bp, Artificial Sequence
  Description of Artificial Sequence: Synthetic oligonucleotide
ctgacctcgtgatccgccag

SEQ ID NO: 9435 - DNA, 20 bp, Artificial Sequence
  Description of Artificial Sequence: Synthetic oligonucleotide
tgacctcgtgatccgccagc

SEQ ID NO: 9436 - DNA, 20 bp, Artificial Sequence
  Description of Artificial Sequence: Synthetic oligonucleotide
gacctcgtgatccgccagcc

SEQ ID NO: 9437 - DNA, 20 bp, Artificial Sequence
  Description of Artificial Sequence: Synthetic oligonucleotide
acctcgtgatccgccagcct

SEQ ID NO: 9438 - DNA, 20 bp, Artificial Sequence
  Description of Artificial Sequence: Synthetic oligonucleotide
cctcgtgatccgccagcctt

SEQ ID NO: 9439 - DNA, 20 bp, Artificial Sequence
  Description of Artificial Sequence: Synthetic oligonucleotide
ctcgtgatccgccagccttg

SEQ ID NO: 9440 - DNA, 20 bp, Artificial Sequence
  Description of Artificial Sequence: Synthetic oligonucleotide
tcgtgatccgccagccttgg

SEQ ID NO: 9441 - DNA, 20 bp, Artificial Sequence
  Description of Artificial Sequence: Synthetic oligonucleotide
cgtgatccgccagccttggc

SEQ ID NO: 9442 - DNA, 20 bp, Artificial Sequence
  Description of Artificial Sequence: Synthetic oligonucleotide
gtgatccgccagccttggcc

SEQ ID NO: 9443 - DNA, 20 bp, Artificial Sequence
  Description of Artificial Sequence: Synthetic oligonucleotide
tgatccgccagccttggcct

SEQ ID NO: 9444 - DNA, 20 bp, Artificial Sequence
  Description of Artificial Sequence: Synthetic oligonucleotide
gatccgccagccttggcctc

SEQ ID NO: 9445 - DNA, 20 bp, Artificial Sequence
  Description of Artificial Sequence: Synthetic oligonucleotide
atccgccagccttggcctcc

SEQ ID NO: 9446 - DNA, 20 bp, Artificial Sequence
  Description of Artificial Sequence: Synthetic oligonucleotide
tccgccagccttggcctccc

SEQ ID NO: 9447 - DNA, 20 bp, Artificial Sequence
  Description of Artificial Sequence: Synthetic oligonucleotide
ccgccagccttggcctccca

SEQ ID NO: 9448 - DNA, 20 bp, Artificial Sequence
  Description of Artificial Sequence: Synthetic oligonucleotide
cgccagccttggcctcccaa

SEQ ID NO: 9449 - DNA, 20 bp, Artificial Sequence
  Description of Artificial Sequence: Synthetic oligonucleotide
gccagccttggcctcccaaa

SEQ ID NO: 9450 - DNA, 20 bp, Artificial Sequence
  Description of Artificial Sequence: Synthetic oligonucleotide
ccagccttggcctcccaaag

SEQ ID NO: 9451 - DNA, 20 bp, Artificial Sequence
  Description of Artificial Sequence: Synthetic oligonucleotide
cagccttggcctcccaaagt

SEQ ID NO: 9452 - DNA, 20 bp, Artificial Sequence
  Description of Artificial Sequence: Synthetic oligonucleotide
agccttggcctcccaaagtg

SEQ ID NO: 9453 - DNA, 20 bp, Artificial Sequence
  Description of Artificial Sequence: Synthetic oligonucleotide
gccttggcctcccaaagtgc

SEQ ID NO: 9454 - DNA, 20 bp, Artificial Sequence
  Description of Artificial Sequence: Synthetic oligonucleotide
ccttggcctcccaaagtgct

SEQ ID NO: 9455 - DNA, 20 bp, Artificial Sequence
  Description of Artificial Sequence: Synthetic oligonucleotide
cttggcctcccaaagtgctg

SEQ ID NO: 9456 - DNA, 20 bp, Artificial Sequence
  Description of Artificial Sequence: Synthetic oligonucleotide
ttggcctcccaaagtgctgg

SEQ ID NO: 9457 - DNA, 20 bp, Artificial Sequence
  Description of Artificial Sequence: Synthetic oligonucleotide
tggcctcccaaagtgctggg

SEQ ID NO: 9458 - DNA, 20 bp, Artificial Sequence
  Description of Artificial Sequence: Synthetic oligonucleotide
ggcctcccaaagtgctggga

SEQ ID NO: 9459 - DNA, 20 bp, Artificial Sequence
  Description of Artificial Sequence: Synthetic oligonucleotide
gcctcccaaagtgctgggat

SEQ ID NO: 9460 - DNA, 20 bp, Artificial Sequence
  Description of Artificial Sequence: Synthetic oligonucleotide
cctcccaaagtgctgggatt

SEQ ID NO: 9461 - DNA, 20 bp, Artificial Sequence
  Description of Artificial Sequence: Synthetic oligonucleotide
ctcccaaagtgctgggatta

SEQ ID NO: 9462 - DNA, 20 bp, Artificial Sequence
  Description of Artificial Sequence: Synthetic oligonucleotide
tcccaaagtgctgggattac

SEQ ID NO: 9463 - DNA, 20 bp, Artificial Sequence
  Description of Artificial Sequence: Synthetic oligonucleotide
cccaaagtgctgggattaca

SEQ ID NO: 9464 - DNA, 20 bp, Artificial Sequence
  Description of Artificial Sequence: Synthetic oligonucleotide
ccaaagtgctgggattacag

SEQ ID NO: 9465 - DNA, 20 bp, Artificial Sequence
  Description of Artificial Sequence: Synthetic oligonucleotide
caaagtgctgggattacagg

SEQ ID NO: 9466 - DNA, 20 bp, Artificial Sequence
  Description of Artificial Sequence: Synthetic oligonucleotide
aaagtgctgggattacaggt

SEQ ID NO: 9467 - DNA, 20 bp, Artificial Sequence
  Description of Artificial Sequence: Synthetic oligonucleotide
aagtgctgggattacaggtg

SEQ ID NO: 9468 - DNA, 20 bp, Artificial Sequence
  Description of Artificial Sequence: Synthetic oligonucleotide
agtgctgggattacaggtgt

SEQ ID NO: 9469 - DNA, 20 bp, Artificial Sequence
  Description of Artificial Sequence: Synthetic oligonucleotide
gtgctgggattacaggtgtg

SEQ ID NO: 9470 - DNA, 20 bp, Artificial Sequence
  Description of Artificial Sequence: Synthetic oligonucleotide
tgctgggattacaggtgtga

SEQ ID NO: 9471 - DNA, 20 bp, Artificial Sequence
  Description of Artificial Sequence: Synthetic oligonucleotide
gctgggattacaggtgtgaa

SEQ ID NO: 9472 - DNA, 20 bp, Artificial Sequence
  Description of Artificial Sequence: Synthetic oligonucleotide
ctgggattacaggtgtgaac

SEQ ID NO: 9473 - DNA, 20 bp, Artificial Sequence
  Description of Artificial Sequence: Synthetic oligonucleotide
tgggattacaggtgtgaacc

SEQ ID NO: 9474 - DNA, 20 bp, Artificial Sequence
  Description of Artificial Sequence: Synthetic oligonucleotide
gggattacaggtgtgaacca

SEQ ID NO: 9475 - DNA, 20 bp, Artificial Sequence
  Description of Artificial Sequence: Synthetic oligonucleotide
ggattacaggtgtgaaccac

SEQ ID NO: 9476 - DNA, 20 bp, Artificial Sequence
  Description of Artificial Sequence: Synthetic oligonucleotide
gattacaggtgtgaaccact

SEQ ID NO: 9477 - DNA, 20 bp, Artificial Sequence
  Description of Artificial Sequence: Synthetic oligonucleotide
attacaggtgtgaaccactg

SEQ ID NO: 9478 - DNA, 20 bp, Artificial Sequence
  Description of Artificial Sequence: Synthetic oligonucleotide
ttacaggtgtgaaccactgc

SEQ ID NO: 9479 - DNA, 20 bp, Artificial Sequence
  Description of Artificial Sequence: Synthetic oligonucleotide
tacaggtgtgaaccactgcg

SEQ ID NO: 9480 - DNA, 20 bp, Artificial Sequence
  Description of Artificial Sequence: Synthetic oligonucleotide
acaggtgtgaaccactgcgc

SEQ ID NO: 9481 - DNA, 20 bp, Artificial Sequence
  Description of Artificial Sequence: Synthetic oligonucleotide
caggtgtgaaccactgcgcc

SEQ ID NO: 9482 - DNA, 20 bp, Artificial Sequence
  Description of Artificial Sequence: Synthetic oligonucleotide
aggtgtgaaccactgcgccc

SEQ ID NO: 9483 - DNA, 20 bp, Artificial Sequence
  Description of Artificial Sequence: Synthetic oligonucleotide
ggtgtgaaccactgcgcccg

SEQ ID NO: 9484 - DNA, 20 bp, Artificial Sequence
  Description of Artificial Sequence: Synthetic oligonucleotide
gtgtgaaccactgcgcccgg

SEQ ID NO: 9485 - DNA, 20 bp, Artificial Sequence
  Description of Artificial Sequence: Synthetic oligonucleotide
tgtgaaccactgcgcccggc

SEQ ID NO: 9486 - DNA, 20 bp, Artificial Sequence
  Description of Artificial Sequence: Synthetic oligonucleotide
gtgaaccactgcgcccggcg

SEQ ID NO: 9487 - DNA, 20 bp, Artificial Sequence
  Description of Artificial Sequence: Synthetic oligonucleotide
tgaaccactgcgcccggcgg

SEQ ID NO: 9488 - DNA, 20 bp, Artificial Sequence
  Description of Artificial Sequence: Synthetic oligonucleotide
gaaccactgcgcccggcggg

SEQ ID NO: 9489 - DNA, 20 bp, Artificial Sequence
  Description of Artificial Sequence: Synthetic oligonucleotide
aaccactgcgcccggcggga

SEQ ID NO: 9490 - DNA, 20 bp, Artificial Sequence
  Description of Artificial Sequence: Synthetic oligonucleotide
accactgcgcccggcgggac

SEQ ID NO: 9491 - DNA, 20 bp, Artificial Sequence
  Description of Artificial Sequence: Synthetic oligonucleotide
ccactgcgcccggcgggact

SEQ ID NO: 9492 - DNA, 20 bp, Artificial Sequence
  Description of Artificial Sequence: Synthetic oligonucleotide
cactgcgcccggcgggactc

SEQ ID NO: 9493 - DNA, 20 bp, Artificial Sequence
  Description of Artificial Sequence: Synthetic oligonucleotide
actgcgcccggcgggactct

SEQ ID NO: 9494 - DNA, 20 bp, Artificial Sequence
  Description of Artificial Sequence: Synthetic oligonucleotide
ctgcgcccggcgggactctc

SEQ ID NO: 9495 - DNA, 20 bp, Artificial Sequence
  Description of Artificial Sequence: Synthetic oligonucleotide
tgcgcccggcgggactctct

SEQ ID NO: 9496 - DNA, 20 bp, Artificial Sequence
  Description of Artificial Sequence: Synthetic oligonucleotide
gcgcccggcgggactctctt

SEQ ID NO: 9497 - DNA, 20 bp, Artificial Sequence
  Description of Artificial Sequence: Synthetic oligonucleotide
cgcccggcgggactctcttt

SEQ ID NO: 9498 - DNA, 20 bp, Artificial Sequence
  Description of Artificial Sequence: Synthetic oligonucleotide
gcccggcgggactctctttc

SEQ ID NO: 9499 - DNA, 20 bp, Artificial Sequence
  Description of Artificial Sequence: Synthetic oligonucleotide
cccggcgggactctctttcc

SEQ ID NO: 9500 - DNA, 20 bp, Artificial Sequence
  Description of Artificial Sequence: Synthetic oligonucleotide
ccggcgggactctctttcct

SEQ ID NO: 9501 - DNA, 20 bp, Artificial Sequence
  Description of Artificial Sequence: Synthetic oligonucleotide
cggcgggactctctttcctc

SEQ ID NO: 9502 - DNA, 20 bp, Artificial Sequence
  Description of Artificial Sequence: Synthetic oligonucleotide
ggcgggactctctttcctca

SEQ ID NO: 9503 - DNA, 20 bp, Artificial Sequence
  Description of Artificial Sequence: Synthetic oligonucleotide
gcgggactctctttcctcac

SEQ ID NO: 9504 - DNA, 20 bp, Artificial Sequence
  Description of Artificial Sequence: Synthetic oligonucleotide
cgggactctctttcctcact

SEQ ID NO: 9505 - DNA, 20 bp, Artificial Sequence
  Description of Artificial Sequence: Synthetic oligonucleotide
gggactctctttcctcactt

SEQ ID NO: 9506 - DNA, 20 bp, Artificial Sequence
  Description of Artificial Sequence: Synthetic oligonucleotide
ggactctctttcctcacttc

SEQ ID NO: 9507 - DNA, 20 bp, Artificial Sequence
  Description of Artificial Sequence: Synthetic oligonucleotide
gactctctttcctcacttct

SEQ ID NO: 9508 - DNA, 20 bp, Artificial Sequence
  Description of Artificial Sequence: Synthetic oligonucleotide
actctctttcctcacttctc

SEQ ID NO: 9509 - DNA, 20 bp, Artificial Sequence
  Description of Artificial Sequence: Synthetic oligonucleotide
ctctctttcctcacttctct

SEQ ID NO: 9510 - DNA, 20 bp, Artificial Sequence
  Description of Artificial Sequence: Synthetic oligonucleotide
tctctttcctcacttctctc

SEQ ID NO: 9511 - DNA, 20 bp, Artificial Sequence
  Description of Artificial Sequence: Synthetic oligonucleotide
ctctttcctcacttctctct

SEQ ID NO: 9512 - DNA, 20 bp, Artificial Sequence
  Description of Artificial Sequence: Synthetic oligonucleotide
tctttcctcacttctctctc

SEQ ID NO: 9513 - DNA, 20 bp, Artificial Sequence
  Description of Artificial Sequence: Synthetic oligonucleotide
ctttcctcacttctctctct

SEQ ID NO: 9514 - DNA, 20 bp, Artificial Sequence
  Description of Artificial Sequence: Synthetic oligonucleotide
tttcctcacttctctctctg

SEQ ID NO: 9515 - DNA, 20 bp, Artificial Sequence
  Description of Artificial Sequence: Synthetic oligonucleotide
ttcctcacttctctctctgg

SEQ ID NO: 9516 - DNA, 20 bp, Artificial Sequence
  Description of Artificial Sequence: Synthetic oligonucleotide
tcctcacttctctctctggg

SEQ ID NO: 9517 - DNA, 20 bp, Artificial Sequence
  Description of Artificial Sequence: Synthetic oligonucleotide
cctcacttctctctctgggt

SEQ ID NO: 9518 - DNA, 20 bp, Artificial Sequence
  Description of Artificial Sequence: Synthetic oligonucleotide
ctcacttctctctctgggtc

SEQ ID NO: 9519 - DNA, 20 bp, Artificial Sequence
  Description of Artificial Sequence: Synthetic oligonucleotide
tcacttctctctctgggtcc

SEQ ID NO: 9520 - DNA, 20 bp, Artificial Sequence
  Description of Artificial Sequence: Synthetic oligonucleotide
cacttctctctctgggtccc

SEQ ID NO: 9521 - DNA, 20 bp, Artificial Sequence
  Description of Artificial Sequence: Synthetic oligonucleotide
acttctctctctgggtccca

SEQ ID NO: 9522 - DNA, 20 bp, Artificial Sequence
  Description of Artificial Sequence: Synthetic oligonucleotide
cttctctctctgggtcccag

SEQ ID NO: 9523 - DNA, 20 bp, Artificial Sequence
  Description of Artificial Sequence: Synthetic oligonucleotide
ttctctctctgggtcccagc

SEQ ID NO: 9524 - DNA, 20 bp, Artificial Sequence
  Description of Artificial Sequence: Synthetic oligonucleotide
tctctctctgggtcccagct

SEQ ID NO: 9525 - DNA, 20 bp, Artificial Sequence
  Description of Artificial Sequence: Synthetic oligonucleotide
ctctctctgggtcccagctt

SEQ ID NO: 9526 - DNA, 20 bp, Artificial Sequence
  Description of Artificial Sequence: Synthetic oligonucleotide
tctctctgggtcccagcttc

SEQ ID NO: 9527 - DNA, 20 bp, Artificial Sequence
  Description of Artificial Sequence: Synthetic oligonucleotide
ctctctgggtcccagcttct

SEQ ID NO: 9528 - DNA, 20 bp, Artificial Sequence
  Description of Artificial Sequence: Synthetic oligonucleotide
tctctgggtcccagcttctg

SEQ ID NO: 9529 - DNA, 20 bp, Artificial Sequence
  Description of Artificial Sequence: Synthetic oligonucleotide
ctctgggtcccagcttctgg

SEQ ID NO: 9530 - DNA, 20 bp, Artificial Sequence
  Description of Artificial Sequence: Synthetic oligonucleotide
tctgggtcccagcttctgga

SEQ ID NO: 9531 - DNA, 20 bp, Artificial Sequence
  Description of Artificial Sequence: Synthetic oligonucleotide
ctgggtcccagcttctggaa

SEQ ID NO: 9532 - DNA, 20 bp, Artificial Sequence
  Description of Artificial Sequence: Synthetic oligonucleotide
tgggtcccagcttctggaag

SEQ ID NO: 9533 - DNA, 20 bp, Artificial Sequence
  Description of Artificial Sequence: Synthetic oligonucleotide
gggtcccagcttctggaagg

SEQ ID NO: 9534 - DNA, 20 bp, Artificial Sequence
  Description of Artificial Sequence: Synthetic oligonucleotide
ggtcccagcttctggaagga

SEQ ID NO: 9535 - DNA, 20 bp, Artificial Sequence
  Description of Artificial Sequence: Synthetic oligonucleotide
gtcccagcttctggaaggac

SEQ ID NO: 9536 - DNA, 20 bp, Artificial Sequence
  Description of Artificial Sequence: Synthetic oligonucleotide
tcccagcttctggaaggaca

SEQ ID NO: 9537 - DNA, 20 bp, Artificial Sequence
  Description of Artificial Sequence: Synthetic oligonucleotide
cccagcttctggaaggacac

SEQ ID NO: 9538 - DNA, 20 bp, Artificial Sequence
  Description of Artificial Sequence: Synthetic oligonucleotide
ccagcttctggaaggacacc

SEQ ID NO: 9539 - DNA, 20 bp, Artificial Sequence
  Description of Artificial Sequence: Synthetic oligonucleotide
cagcttctggaaggacaccc

SEQ ID NO: 9540 - DNA, 20 bp, Artificial Sequence
  Description of Artificial Sequence: Synthetic oligonucleotide
agcttctggaaggacaccct

SEQ ID NO: 9541 - DNA, 20 bp, Artificial Sequence
  Description of Artificial Sequence: Synthetic oligonucleotide
gcttctggaaggacaccctg

SEQ ID NO: 9542 - DNA, 20 bp, Artificial Sequence
  Description of Artificial Sequence: Synthetic oligonucleotide
cttctggaaggacaccctgc

SEQ ID NO: 9543 - DNA, 20 bp, Artificial Sequence
  Description of Artificial Sequence: Synthetic oligonucleotide
ttctggaaggacaccctgcc

SEQ ID NO: 9544 - DNA, 20 bp, Artificial Sequence
  Description of Artificial Sequence: Synthetic oligonucleotide
tctggaaggacaccctgcct

SEQ ID NO: 9545 - DNA, 20 bp, Artificial Sequence
  Description of Artificial Sequence: Synthetic oligonucleotide
ctggaaggacaccctgcctt

SEQ ID NO: 9546 - DNA, 20 bp, Artificial Sequence
  Description of Artificial Sequence: Synthetic oligonucleotide
tggaaggacaccctgccttg

SEQ ID NO: 9547 - DNA, 20 bp, Artificial Sequence
  Description of Artificial Sequence: Synthetic oligonucleotide
ggaaggacaccctgccttgc

SEQ ID NO: 9548 - DNA, 20 bp, Artificial Sequence
  Description of Artificial Sequence: Synthetic oligonucleotide
gaaggacaccctgccttgcc

SEQ ID NO: 9549 - DNA, 20 bp, Artificial Sequence
  Description of Artificial Sequence: Synthetic oligonucleotide
aaggacaccctgccttgcct

SEQ ID NO: 9550 - DNA, 20 bp, Artificial Sequence
  Description of Artificial Sequence: Synthetic oligonucleotide
aggacaccctgccttgcctc

SEQ ID NO: 9551 - DNA, 20 bp, Artificial Sequence
  Description of Artificial Sequence: Synthetic oligonucleotide
ggacaccctgccttgcctca

SEQ ID NO: 9552 - DNA, 20 bp, Artificial Sequence
  Description of Artificial Sequence: Synthetic oligonucleotide
gacaccctgccttgcctcac

SEQ ID NO: 9553 - DNA, 20 bp, Artificial Sequence
  Description of Artificial Sequence: Synthetic oligonucleotide
acaccctgccttgcctcacc

SEQ ID NO: 9554 - DNA, 20 bp, Artificial Sequence
  Description of Artificial Sequence: Synthetic oligonucleotide
caccctgccttgcctcaccc

SEQ ID NO: 9555 - DNA, 20 bp, Artificial Sequence
  Description of Artificial Sequence: Synthetic oligonucleotide
accctgccttgcctcacccc

SEQ ID NO: 9556 - DNA, 20 bp, Artificial Sequence
  Description of Artificial Sequence: Synthetic oligonucleotide
ccctgccttgcctcaccccc

SEQ ID NO: 9557 - DNA, 20 bp, Artificial Sequence
  Description of Artificial Sequence: Synthetic oligonucleotide
cctgccttgcctcaccccca

SEQ ID NO: 9558 - DNA, 20 bp, Artificial Sequence
  Description of Artificial Sequence: Synthetic oligonucleotide
ctgccttgcctcacccccag

SEQ ID NO: 9559 - DNA, 20 bp, Artificial Sequence
  Description of Artificial Sequence: Synthetic oligonucleotide
tgccttgcctcacccccaga

SEQ ID NO: 9560 - DNA, 20 bp, Artificial Sequence
  Description of Artificial Sequence: Synthetic oligonucleotide
gccttgcctcacccccagac

SEQ ID NO: 9561 - DNA, 20 bp, Artificial Sequence
  Description of Artificial Sequence: Synthetic oligonucleotide
ccttgcctcacccccagacc

SEQ ID NO: 9562 - DNA, 20 bp, Artificial Sequence
  Description of Artificial Sequence: Synthetic oligonucleotide
cttgcctcacccccagacca

SEQ ID NO: 9563 - DNA, 20 bp, Artificial Sequence
  Description of Artificial Sequence: Synthetic oligonucleotide
ttgcctcacccccagaccag

SEQ ID NO: 9564 - DNA, 20 bp, Artificial Sequence
  Description of Artificial Sequence: Synthetic oligonucleotide
tgcctcacccccagaccagg

SEQ ID NO: 9565 - DNA, 20 bp, Artificial Sequence
  Description of Artificial Sequence: Synthetic oligonucleotide
gcctcacccccagaccaggc

SEQ ID NO: 9566 - DNA, 20 bp, Artificial Sequence
  Description of Artificial Sequence: Synthetic oligonucleotide
cctcacccccagaccaggcc

SEQ ID NO: 9567 - DNA, 20 bp, Artificial Sequence
  Description of Artificial Sequence: Synthetic oligonucleotide
ctcacccccagaccaggcca

SEQ ID NO: 9568 - DNA, 20 bp, Artificial Sequence
  Description of Artificial Sequence: Synthetic oligonucleotide
tcacccccagaccaggccag

SEQ ID NO: 9569 - DNA, 20 bp, Artificial Sequence
  Description of Artificial Sequence: Synthetic oligonucleotide
cacccccagaccaggccaga

SEQ ID NO: 9570 - DNA, 20 bp, Artificial Sequence
  Description of Artificial Sequence: Synthetic oligonucleotide
acccccagaccaggccagaa

SEQ ID NO: 9571 - DNA, 20 bp, Artificial Sequence
  Description of Artificial Sequence: Synthetic oligonucleotide
cccccagaccaggccagaac

SEQ ID NO: 9572 - DNA, 20 bp, Artificial Sequence
  Description of Artificial Sequence: Synthetic oligonucleotide
ccccagaccaggccagaaca

SEQ ID NO: 9573 - DNA, 20 bp, Artificial Sequence
  Description of Artificial Sequence: Synthetic oligonucleotide
cccagaccaggccagaacac

SEQ ID NO: 9574 - DNA, 20 bp, Artificial Sequence
  Description of Artificial Sequence: Synthetic oligonucleotide
ccagaccaggccagaacacc

SEQ ID NO: 9575 - DNA, 20 bp, Artificial Sequence
  Description of Artificial Sequence: Synthetic oligonucleotide
cagaccaggccagaacaccc

SEQ ID NO: 9576 - DNA, 20 bp, Artificial Sequence
  Description of Artificial Sequence: Synthetic oligonucleotide
agaccaggccagaacacccc

SEQ ID NO: 9577 - DNA, 20 bp, Artificial Sequence
  Description of Artificial Sequence: Synthetic oligonucleotide
gaccaggccagaacacccca

SEQ ID NO: 9578 - DNA, 20 bp, Artificial Sequence
  Description of Artificial Sequence: Synthetic oligonucleotide
accaggccagaacaccccaa

SEQ ID NO: 9579 - DNA, 20 bp, Artificial Sequence
  Description of Artificial Sequence: Synthetic oligonucleotide
ccaggccagaacaccccaaa

SEQ ID NO: 9580 - DNA, 20 bp, Artificial Sequence
  Description of Artificial Sequence: Synthetic oligonucleotide
caggccagaacaccccaaat

SEQ ID NO: 9581 - DNA, 20 bp, Artificial Sequence
  Description of Artificial Sequence: Synthetic oligonucleotide
aggccagaacaccccaaatg

SEQ ID NO: 9582 - DNA, 20 bp, Artificial Sequence
  Description of Artificial Sequence: Synthetic oligonucleotide
ggccagaacaccccaaatgg

SEQ ID NO: 9583 - DNA, 20 bp, Artificial Sequence
  Description of Artificial Sequence: Synthetic oligonucleotide
gccagaacaccccaaatggg

SEQ ID NO: 9584 - DNA, 20 bp, Artificial Sequence
  Description of Artificial Sequence: Synthetic oligonucleotide
ccagaacaccccaaatggga

SEQ ID NO: 9585 - DNA, 20 bp, Artificial Sequence
  Description of Artificial Sequence: Synthetic oligonucleotide
cagaacaccccaaatgggaa

SEQ ID NO: 9586 - DNA, 20 bp, Artificial Sequence
  Description of Artificial Sequence: Synthetic oligonucleotide
agaacaccccaaatgggaat

SEQ ID NO: 9587 - DNA, 20 bp, Artificial Sequence
  Description of Artificial Sequence: Synthetic oligonucleotide
gaacaccccaaatgggaatt

SEQ ID NO: 9588 - DNA, 20 bp, Artificial Sequence
  Description of Artificial Sequence: Synthetic oligonucleotide
aacaccccaaatgggaattg

SEQ ID NO: 9589 - DNA, 20 bp, Artificial Sequence
  Description of Artificial Sequence: Synthetic oligonucleotide
acaccccaaatgggaattga

SEQ ID NO: 9590 - DNA, 20 bp, Artificial Sequence
  Description of Artificial Sequence: Synthetic oligonucleotide
caccccaaatgggaattgag

SEQ ID NO: 9591 - DNA, 20 bp, Artificial Sequence
  Description of Artificial Sequence: Synthetic oligonucleotide
accccaaatgggaattgagc

SEQ ID NO: 9592 - DNA, 20 bp, Artificial Sequence
  Description of Artificial Sequence: Synthetic oligonucleotide
ccccaaatgggaattgagca

SEQ ID NO: 9593 - DNA, 20 bp, Artificial Sequence
  Description of Artificial Sequence: Synthetic oligonucleotide
cccaaatgggaattgagcaa

SEQ ID NO: 9594 - DNA, 20 bp, Artificial Sequence
  Description of Artificial Sequence: Synthetic oligonucleotide
ccaaatgggaattgagcaag

SEQ ID NO: 9595 - DNA, 20 bp, Artificial Sequence
  Description of Artificial Sequence: Synthetic oligonucleotide
caaatgggaattgagcaagg

SEQ ID NO: 9596 - DNA, 20 bp, Artificial Sequence
  Description of Artificial Sequence: Synthetic oligonucleotide
aaatgggaattgagcaagga

SEQ ID NO: 9597 - DNA, 20 bp, Artificial Sequence
  Description of Artificial Sequence: Synthetic oligonucleotide
aatgggaattgagcaaggac

SEQ ID NO: 9598 - DNA, 20 bp, Artificial Sequence
  Description of Artificial Sequence: Synthetic oligonucleotide
atgggaattgagcaaggact

SEQ ID NO: 9599 - DNA, 20 bp, Artificial Sequence
  Description of Artificial Sequence: Synthetic oligonucleotide
tgggaattgagcaaggactt

SEQ ID NO: 9600 - DNA, 20 bp, Artificial Sequence
  Description of Artificial Sequence: Synthetic oligonucleotide
gggaattgagcaaggacttc

SEQ ID NO: 9601 - DNA, 20 bp, Artificial Sequence
  Description of Artificial Sequence: Synthetic oligonucleotide
ggaattgagcaaggacttcc

SEQ ID NO: 9602 - DNA, 20 bp, Artificial Sequence
  Description of Artificial Sequence: Synthetic oligonucleotide
gaattgagcaaggacttccc

SEQ ID NO: 9603 - DNA, 20 bp, Artificial Sequence
  Description of Artificial Sequence: Synthetic oligonucleotide
aattgagcaaggacttccca

SEQ ID NO: 9604 - DNA, 20 bp, Artificial Sequence
  Description of Artificial Sequence: Synthetic oligonucleotide
attgagcaaggacttcccac

SEQ ID NO: 9605 - DNA, 20 bp, Artificial Sequence
  Description of Artificial Sequence: Synthetic oligonucleotide
ttgagcaaggacttcccact

SEQ ID NO: 9606 - DNA, 20 bp, Artificial Sequence
  Description of Artificial Sequence: Synthetic oligonucleotide
tgagcaaggacttcccactc

SEQ ID NO: 9607 - DNA, 20 bp, Artificial Sequence
  Description of Artificial Sequence: Synthetic oligonucleotide
gagcaaggacttcccactcc

SEQ ID NO: 9608 - DNA, 20 bp, Artificial Sequence
  Description of Artificial Sequence: Synthetic oligonucleotide
agcaaggacttcccactcct

SEQ ID NO: 9609 - DNA, 20 bp, Artificial Sequence
  Description of Artificial Sequence: Synthetic oligonucleotide
gcaaggacttcccactcctg

SEQ ID NO: 9610 - DNA, 20 bp, Artificial Sequence
  Description of Artificial Sequence: Synthetic oligonucleotide
caaggacttcccactcctgg

SEQ ID NO: 9611 - DNA, 20 bp, Artificial Sequence
  Description of Artificial Sequence: Synthetic oligonucleotide
aaggacttcccactcctgga

SEQ ID NO: 9612 - DNA, 20 bp, Artificial Sequence
  Description of Artificial Sequence: Synthetic oligonucleotide
aggacttcccactcctggac

SEQ ID NO: 9613 - DNA, 20 bp, Artificial Sequence
  Description of Artificial Sequence: Synthetic oligonucleotide
ggacttcccactcctggaca

SEQ ID NO: 9614 - DNA, 20 bp, Artificial Sequence
  Description of Artificial Sequence: Synthetic oligonucleotide
gacttcccactcctggacac

SEQ ID NO: 9615 - DNA, 20 bp, Artificial Sequence
  Description of Artificial Sequence: Synthetic oligonucleotide
acttcccactcctggacact

SEQ ID NO: 9616 - DNA, 20 bp, Artificial Sequence
  Description of Artificial Sequence: Synthetic oligonucleotide
cttcccactcctggacactg

SEQ ID NO: 9617 - DNA, 20 bp, Artificial Sequence
  Description of Artificial Sequence: Synthetic oligonucleotide
ttcccactcctggacactga

SEQ ID NO: 9618 - DNA, 20 bp, Artificial Sequence
  Description of Artificial Sequence: Synthetic oligonucleotide
tcccactcctggacactgag

SEQ ID NO: 9619 - DNA, 20 bp, Artificial Sequence
  Description of Artificial Sequence: Synthetic oligonucleotide
cccactcctggacactgagg

SEQ ID NO: 9620 - DNA, 20 bp, Artificial Sequence
  Description of Artificial Sequence: Synthetic oligonucleotide
ccactcctggacactgaggt

SEQ ID NO: 9621 - DNA, 20 bp, Artificial Sequence
  Description of Artificial Sequence: Synthetic oligonucleotide
cactcctggacactgaggtc

SEQ ID NO: 9622 - DNA, 20 bp, Artificial Sequence
  Description of Artificial Sequence: Synthetic oligonucleotide
actcctggacactgaggtca

SEQ ID NO: 9623 - DNA, 20 bp, Artificial Sequence
  Description of Artificial Sequence: Synthetic oligonucleotide
ctcctggacactgaggtcat

SEQ ID NO: 9624 - DNA, 20 bp, Artificial Sequence
  Description of Artificial Sequence: Synthetic oligonucleotide
tcctggacactgaggtcatc

SEQ ID NO: 9625 - DNA, 20 bp, Artificial Sequence
  Description of Artificial Sequence: Synthetic oligonucleotide
cctggacactgaggtcatct

SEQ ID NO: 9626 - DNA, 20 bp, Artificial Sequence
  Description of Artificial Sequence: Synthetic oligonucleotide
ctggacactgaggtcatcta

SEQ ID NO: 9627 - DNA, 20 bp, Artificial Sequence
  Description of Artificial Sequence: Synthetic oligonucleotide
tggacactgaggtcatctaa

SEQ ID NO: 9628 - DNA, 20 bp, Artificial Sequence
  Description of Artificial Sequence: Synthetic oligonucleotide
ggacactgaggtcatctaat

SEQ ID NO: 9629 - DNA, 20 bp, Artificial Sequence
  Description of Artificial Sequence: Synthetic oligonucleotide
gacactgaggtcatctaatg

SEQ ID NO: 9630 - DNA, 20 bp, Artificial Sequence
  Description of Artificial Sequence: Synthetic oligonucleotide
acactgaggtcatctaatgg

SEQ ID NO: 9631 - DNA, 20 bp, Artificial Sequence
  Description of Artificial Sequence: Synthetic oligonucleotide
cactgaggtcatctaatggt

SEQ ID NO: 9632 - DNA, 20 bp, Artificial Sequence
  Description of Artificial Sequence: Synthetic oligonucleotide
actgaggtcatctaatggtc

SEQ ID NO: 9633 - DNA, 20 bp, Artificial Sequence
  Description of Artificial Sequence: Synthetic oligonucleotide
ctgaggtcatctaatggtct

SEQ ID NO: 9634 - DNA, 20 bp, Artificial Sequence
  Description of Artificial Sequence: Synthetic oligonucleotide
tgaggtcatctaatggtctc

SEQ ID NO: 9635 - DNA, 20 bp, Artificial Sequence
  Description of Artificial Sequence: Synthetic oligonucleotide
gaggtcatctaatggtctct

SEQ ID NO: 9636 - DNA, 20 bp, Artificial Sequence
  Description of Artificial Sequence: Synthetic oligonucleotide
aggtcatctaatggtctctc

SEQ ID NO: 9637 - DNA, 20 bp, Artificial Sequence
  Description of Artificial Sequence: Synthetic oligonucleotide
ggtcatctaatggtctctcc

SEQ ID NO: 9638 - DNA, 20 bp, Artificial Sequence
  Description of Artificial Sequence: Synthetic oligonucleotide
gtcatctaatggtctctcct

SEQ ID NO: 9639 - DNA, 20 bp, Artificial Sequence
  Description of Artificial Sequence: Synthetic oligonucleotide
tcatctaatggtctctcctc

SEQ ID NO: 9640 - DNA, 20 bp, Artificial Sequence
  Description of Artificial Sequence: Synthetic oligonucleotide
catctaatggtctctcctct

SEQ ID NO: 9641 - DNA, 20 bp, Artificial Sequence
  Description of Artificial Sequence: Synthetic oligonucleotide
atctaatggtctctcctctg

SEQ ID NO: 9642 - DNA, 20 bp, Artificial Sequence
  Description of Artificial Sequence: Synthetic oligonucleotide
tctaatggtctctcctctga

SEQ ID NO: 9643 - DNA, 20 bp, Artificial Sequence
  Description of Artificial Sequence: Synthetic oligonucleotide
ctaatggtctctcctctgac

SEQ ID NO: 9644 - DNA, 20 bp, Artificial Sequence
  Description of Artificial Sequence: Synthetic oligonucleotide
taatggtctctcctctgact

SEQ ID NO: 9645 - DNA, 20 bp, Artificial Sequence
  Description of Artificial Sequence: Synthetic oligonucleotide
aatggtctctcctctgactc

SEQ ID NO: 9646 - DNA, 20 bp, Artificial Sequence
  Description of Artificial Sequence: Synthetic oligonucleotide
atggtctctcctctgactca

SEQ ID NO: 9647 - DNA, 20 bp, Artificial Sequence
  Description of Artificial Sequence: Synthetic oligonucleotide
tggtctctcctctgactcaa

SEQ ID NO: 9648 - DNA, 20 bp, Artificial Sequence
  Description of Artificial Sequence: Synthetic oligonucleotide
ggtctctcctctgactcaat

SEQ ID NO: 9649 - DNA, 20 bp, Artificial Sequence
  Description of Artificial Sequence: Synthetic oligonucleotide
gtctctcctctgactcaatg

SEQ ID NO: 9650 - DNA, 20 bp, Artificial Sequence
  Description of Artificial Sequence: Synthetic oligonucleotide
tctctcctctgactcaatgg

SEQ ID NO: 9651 - DNA, 20 bp, Artificial Sequence
  Description of Artificial Sequence: Synthetic oligonucleotide
ctctcctctgactcaatgga

SEQ ID NO: 9652 - DNA, 20 bp, Artificial Sequence
  Description of Artificial Sequence: Synthetic oligonucleotide
tctcctctgactcaatggag

SEQ ID NO: 9653 - DNA, 20 bp, Artificial Sequence
  Description of Artificial Sequence: Synthetic oligonucleotide
ctcctctgactcaatggagg

SEQ ID NO: 9654 - DNA, 20 bp, Artificial Sequence
  Description of Artificial Sequence: Synthetic oligonucleotide
tcctctgactcaatggaggc

SEQ ID NO: 9655 - DNA, 20 bp, Artificial Sequence
  Description of Artificial Sequence: Synthetic oligonucleotide
cctctgactcaatggaggct

SEQ ID NO: 9656 - DNA, 20 bp, Artificial Sequence
  Description of Artificial Sequence: Synthetic oligonucleotide
ctctgactcaatggaggctc

SEQ ID NO: 9657 - DNA, 20 bp, Artificial Sequence
  Description of Artificial Sequence: Synthetic oligonucleotide
tctgactcaatggaggctcc

SEQ ID NO: 9658 - DNA, 20 bp, Artificial Sequence
  Description of Artificial Sequence: Synthetic oligonucleotide
ctgactcaatggaggctcca

SEQ ID NO: 9659 - DNA, 20 bp, Artificial Sequence
  Description of Artificial Sequence: Synthetic oligonucleotide
tgactcaatggaggctccat

SEQ ID NO: 9660 - DNA, 20 bp, Artificial Sequence
  Description of Artificial Sequence: Synthetic oligonucleotide
gactcaatggaggctccatg

SEQ ID NO: 9661 - DNA, 20 bp, Artificial Sequence
  Description of Artificial Sequence: Synthetic oligonucleotide
actcaatggaggctccatga

SEQ ID NO: 9662 - DNA, 20 bp, Artificial Sequence
  Description of Artificial Sequence: Synthetic oligonucleotide
ctcaatggaggctccatgag

SEQ ID NO: 9663 - DNA, 20 bp, Artificial Sequence
  Description of Artificial Sequence: Synthetic oligonucleotide
tcaatggaggctccatgagg

SEQ ID NO: 9664 - DNA, 20 bp, Artificial Sequence
  Description of Artificial Sequence: Synthetic oligonucleotide
caatggaggctccatgaggc

SEQ ID NO: 9665 - DNA, 20 bp, Artificial Sequence
  Description of Artificial Sequence: Synthetic oligonucleotide
aatggaggctccatgaggct

SEQ ID NO: 9666 - DNA, 20 bp, Artificial Sequence
  Description of Artificial Sequence: Synthetic oligonucleotide
atggaggctccatgaggctg

SEQ ID NO: 9667 - DNA, 20 bp, Artificial Sequence
  Description of Artificial Sequence: Synthetic oligonucleotide
tggaggctccatgaggctgg

SEQ ID NO: 9668 - DNA, 20 bp, Artificial Sequence
  Description of Artificial Sequence: Synthetic oligonucleotide
ggaggctccatgaggctggg

SEQ ID NO: 9669 - DNA, 20 bp, Artificial Sequence
  Description of Artificial Sequence: Synthetic oligonucleotide
gaggctccatgaggctgggg

SEQ ID NO: 9670 - DNA, 20 bp, Artificial Sequence
  Description of Artificial Sequence: Synthetic oligonucleotide
aggctccatgaggctgggga

SEQ ID NO: 9671 - DNA, 20 bp, Artificial Sequence
  Description of Artificial Sequence: Synthetic oligonucleotide
ggctccatgaggctggggac

SEQ ID NO: 9672 - DNA, 20 bp, Artificial Sequence
  Description of Artificial Sequence: Synthetic oligonucleotide
gctccatgaggctggggaca

SEQ ID NO: 9673 - DNA, 20 bp, Artificial Sequence
  Description of Artificial Sequence: Synthetic oligonucleotide
ctccatgaggctggggacaa

SEQ ID NO: 9674 - DNA, 20 bp, Artificial Sequence
  Description of Artificial Sequence: Synthetic oligonucleotide
tccatgaggctggggacaag

SEQ ID NO: 9675 - DNA, 20 bp, Artificial Sequence
  Description of Artificial Sequence: Synthetic oligonucleotide
ccatgaggctggggacaagg

SEQ ID NO: 9676 - DNA, 20 bp, Artificial Sequence
  Description of Artificial Sequence: Synthetic oligonucleotide
catgaggctggggacaagga

SEQ ID NO: 9677 - DNA, 20 bp, Artificial Sequence
  Description of Artificial Sequence: Synthetic oligonucleotide
atgaggctggggacaaggag

SEQ ID NO: 9678 - DNA, 20 bp, Artificial Sequence
  Description of Artificial Sequence: Synthetic oligonucleotide
tgaggctggggacaaggagc

SEQ ID NO: 9679 - DNA, 20 bp, Artificial Sequence
  Description of Artificial Sequence: Synthetic oligonucleotide
gaggctggggacaaggagca

SEQ ID NO: 9680 - DNA, 20 bp, Artificial Sequence
  Description of Artificial Sequence: Synthetic oligonucleotide
aggctggggacaaggagcag

SEQ ID NO: 9681 - DNA, 20 bp, Artificial Sequence
  Description of Artificial Sequence: Synthetic oligonucleotide
ggctggggacaaggagcagc

SEQ ID NO: 9682 - DNA, 20 bp, Artificial Sequence
  Description of Artificial Sequence: Synthetic oligonucleotide
gctggggacaaggagcagct

SEQ ID NO: 9683 - DNA, 20 bp, Artificial Sequence
  Description of Artificial Sequence: Synthetic oligonucleotide
ctggggacaaggagcagctc

SEQ ID NO: 9684 - DNA, 20 bp, Artificial Sequence
  Description of Artificial Sequence: Synthetic oligonucleotide
tggggacaaggagcagctct

SEQ ID NO: 9685 - DNA, 20 bp, Artificial Sequence
  Description of Artificial Sequence: Synthetic oligonucleotide
ggggacaaggagcagctctg

SEQ ID NO: 9686 - DNA, 20 bp, Artificial Sequence
  Description of Artificial Sequence: Synthetic oligonucleotide
gggacaaggagcagctctgc

SEQ ID NO: 9687 - DNA, 20 bp, Artificial Sequence
  Description of Artificial Sequence: Synthetic oligonucleotide
ggacaaggagcagctctgcc

SEQ ID NO: 9688 - DNA, 20 bp, Artificial Sequence
  Description of Artificial Sequence: Synthetic oligonucleotide
gacaaggagcagctctgccc

SEQ ID NO: 9689 - DNA, 20 bp, Artificial Sequence
  Description of Artificial Sequence: Synthetic oligonucleotide
acaaggagcagctctgccca

SEQ ID NO: 9690 - DNA, 20 bp, Artificial Sequence
  Description of Artificial Sequence: Synthetic oligonucleotide
caaggagcagctctgcccac

SEQ ID NO: 9691 - DNA, 20 bp, Artificial Sequence
  Description of Artificial Sequence: Synthetic oligonucleotide
aaggagcagctctgcccaca

SEQ ID NO: 9692 - DNA, 20 bp, Artificial Sequence
  Description of Artificial Sequence: Synthetic oligonucleotide
aggagcagctctgcccacag

SEQ ID NO: 9693 - DNA, 20 bp, Artificial Sequence
  Description of Artificial Sequence: Synthetic oligonucleotide
ggagcagctctgcccacagc

SEQ ID NO: 9694 - DNA, 20 bp, Artificial Sequence
  Description of Artificial Sequence: Synthetic oligonucleotide
gagcagctctgcccacagcc

SEQ ID NO: 9695 - DNA, 20 bp, Artificial Sequence
  Description of Artificial Sequence: Synthetic oligonucleotide
agcagctctgcccacagcct

SEQ ID NO: 9696 - DNA, 20 bp, Artificial Sequence
  Description of Artificial Sequence: Synthetic oligonucleotide
gcagctctgcccacagcctg

SEQ ID NO: 9697 - DNA, 20 bp, Artificial Sequence
  Description of Artificial Sequence: Synthetic oligonucleotide
cagctctgcccacagcctgg

SEQ ID NO: 9698 - DNA, 20 bp, Artificial Sequence
  Description of Artificial Sequence: Synthetic oligonucleotide
agctctgcccacagcctggc

SEQ ID NO: 9699 - DNA, 20 bp, Artificial Sequence
  Description of Artificial Sequence: Synthetic oligonucleotide
gctctgcccacagcctggca

SEQ ID NO: 9700 - DNA, 20 bp, Artificial Sequence
  Description of Artificial Sequence: Synthetic oligonucleotide
ctctgcccacagcctggcac

SEQ ID NO: 9701 - DNA, 20 bp, Artificial Sequence
  Description of Artificial Sequence: Synthetic oligonucleotide
tctgcccacagcctggcacc

SEQ ID NO: 9702 - DNA, 20 bp, Artificial Sequence
  Description of Artificial Sequence: Synthetic oligonucleotide
ctgcccacagcctggcacca

SEQ ID NO: 9703 - DNA, 20 bp, Artificial Sequence
  Description of Artificial Sequence: Synthetic oligonucleotide
tgcccacagcctggcaccag

SEQ ID NO: 9704 - DNA, 20 bp, Artificial Sequence
  Description of Artificial Sequence: Synthetic oligonucleotide
gcccacagcctggcaccagc

SEQ ID NO: 9705 - DNA, 20 bp, Artificial Sequence
  Description of Artificial Sequence: Synthetic oligonucleotide
cccacagcctggcaccagca

SEQ ID NO: 9706 - DNA, 20 bp, Artificial Sequence
  Description of Artificial Sequence: Synthetic oligonucleotide
ccacagcctggcaccagcat

SEQ ID NO: 9707 - DNA, 20 bp, Artificial Sequence
  Description of Artificial Sequence: Synthetic oligonucleotide
cacagcctggcaccagcatc

SEQ ID NO: 9708 - DNA, 20 bp, Artificial Sequence
  Description of Artificial Sequence: Synthetic oligonucleotide
acagcctggcaccagcatcc

SEQ ID NO: 9709 - DNA, 20 bp, Artificial Sequence
  Description of Artificial Sequence: Synthetic oligonucleotide
cagcctggcaccagcatcca

SEQ ID NO: 9710 - DNA, 20 bp, Artificial Sequence
  Description of Artificial Sequence: Synthetic oligonucleotide
agcctggcaccagcatccac

SEQ ID NO: 9711 - DNA, 20 bp, Artificial Sequence
  Description of Artificial Sequence: Synthetic oligonucleotide
gcctggcaccagcatccacg

SEQ ID NO: 9712 - DNA, 20 bp, Artificial Sequence
  Description of Artificial Sequence: Synthetic oligonucleotide
cctggcaccagcatccacgc

SEQ ID NO: 9713 - DNA, 20 bp, Artificial Sequence
  Description of Artificial Sequence: Synthetic oligonucleotide
ctggcaccagcatccacgca

SEQ ID NO: 9714 - DNA, 20 bp, Artificial Sequence
  Description of Artificial Sequence: Synthetic oligonucleotide
tggcaccagcatccacgcag

SEQ ID NO: 9715 - DNA, 20 bp, Artificial Sequence
  Description of Artificial Sequence: Synthetic oligonucleotide
ggcaccagcatccacgcagg

SEQ ID NO: 9716 - DNA, 20 bp, Artificial Sequence
  Description of Artificial Sequence: Synthetic oligonucleotide
gcaccagcatccacgcaggc

SEQ ID NO: 9717 - DNA, 20 bp, Artificial Sequence
  Description of Artificial Sequence: Synthetic oligonucleotide
caccagcatccacgcaggcc

SEQ ID NO: 9718 - DNA, 20 bp, Artificial Sequence
  Description of Artificial Sequence: Synthetic oligonucleotide
accagcatccacgcaggccc

SEQ ID NO: 9719 - DNA, 20 bp, Artificial Sequence
  Description of Artificial Sequence: Synthetic oligonucleotide
ccagcatccacgcaggcccc

SEQ ID NO: 9720 - DNA, 20 bp, Artificial Sequence
  Description of Artificial Sequence: Synthetic oligonucleotide
cagcatccacgcaggcccca

SEQ ID NO: 9721 - DNA, 20 bp, Artificial Sequence
  Description of Artificial Sequence: Synthetic oligonucleotide
agcatccacgcaggccccag

SEQ ID NO: 9722 - DNA, 20 bp, Artificial Sequence
  Description of Artificial Sequence: Synthetic oligonucleotide
gcatccacgcaggccccagc

SEQ ID NO: 9723 - DNA, 20 bp, Artificial Sequence
  Description of Artificial Sequence: Synthetic oligonucleotide
catccacgcaggccccagcg

SEQ ID NO: 9724 - DNA, 20 bp, Artificial Sequence
  Description of Artificial Sequence: Synthetic oligonucleotide
atccacgcaggccccagcgc

SEQ ID NO: 9725 - DNA, 20 bp, Artificial Sequence
  Description of Artificial Sequence: Synthetic oligonucleotide
tccacgcaggccccagcgca

SEQ ID NO: 9726 - DNA, 20 bp, Artificial Sequence
  Description of Artificial Sequence: Synthetic oligonucleotide
ccacgcaggccccagcgcat

SEQ ID NO: 9727 - DNA, 20 bp, Artificial Sequence
  Description of Artificial Sequence: Synthetic oligonucleotide
cacgcaggccccagcgcata

SEQ ID NO: 9728 - DNA, 20 bp, Artificial Sequence
  Description of Artificial Sequence: Synthetic oligonucleotide
acgcaggccccagcgcatag

SEQ ID NO: 9729 - DNA, 20 bp, Artificial Sequence
  Description of Artificial Sequence: Synthetic oligonucleotide
cgcaggccccagcgcatagc

SEQ ID NO: 9730 - DNA, 20 bp, Artificial Sequence
  Description of Artificial Sequence: Synthetic oligonucleotide
gcaggccccagcgcatagca

SEQ ID NO: 9731 - DNA, 20 bp, Artificial Sequence
  Description of Artificial Sequence: Synthetic oligonucleotide
caggccccagcgcatagcag

SEQ ID NO: 9732 - DNA, 20 bp, Artificial Sequence
  Description of Artificial Sequence: Synthetic oligonucleotide
aggccccagcgcatagcagc

SEQ ID NO: 9733 - DNA, 20 bp, Artificial Sequence
  Description of Artificial Sequence: Synthetic oligonucleotide
ggccccagcgcatagcagct

SEQ ID NO: 9734 - DNA, 20 bp, Artificial Sequence
  Description of Artificial Sequence: Synthetic oligonucleotide
gccccagcgcatagcagctg

SEQ ID NO: 9735 - DNA, 20 bp, Artificial Sequence
  Description of Artificial Sequence: Synthetic oligonucleotide
ccccagcgcatagcagctgc

SEQ ID NO: 9736 - DNA, 20 bp, Artificial Sequence
  Description of Artificial Sequence: Synthetic oligonucleotide
cccagcgcatagcagctgct

SEQ ID NO: 9737 - DNA, 20 bp, Artificial Sequence
  Description of Artificial Sequence: Synthetic oligonucleotide
ccagcgcatagcagctgctc

SEQ ID NO: 9738 - DNA, 20 bp, Artificial Sequence
  Description of Artificial Sequence: Synthetic oligonucleotide
cagcgcatagcagctgctca

SEQ ID NO: 9739 - DNA, 20 bp, Artificial Sequence
  Description of Artificial Sequence: Synthetic oligonucleotide
agcgcatagcagctgctcaa

SEQ ID NO: 9740 - DNA, 20 bp, Artificial Sequence
  Description of Artificial Sequence: Synthetic oligonucleotide
gcgcatagcagctgctcaat

SEQ ID NO: 9741 - DNA, 20 bp, Artificial Sequence
  Description of Artificial Sequence: Synthetic oligonucleotide
cgcatagcagctgctcaata

SEQ ID NO: 9742 - DNA, 20 bp, Artificial Sequence
  Description of Artificial Sequence: Synthetic oligonucleotide
gcatagcagctgctcaataa

SEQ ID NO: 9743 - DNA, 20 bp, Artificial Sequence
  Description of Artificial Sequence: Synthetic oligonucleotide
catagcagctgctcaataaa

SEQ ID NO: 9744 - DNA, 20 bp, Artificial Sequence
  Description of Artificial Sequence: Synthetic oligonucleotide
atagcagctgctcaataaag

SEQ ID NO: 9745 - DNA, 20 bp, Artificial Sequence
  Description of Artificial Sequence: Synthetic oligonucleotide
tagcagctgctcaataaaga

SEQ ID NO: 9746 - DNA, 20 bp, Artificial Sequence
  Description of Artificial Sequence: Synthetic oligonucleotide
agcagctgctcaataaagac

SEQ ID NO: 9747 - DNA, 20 bp, Artificial Sequence
  Description of Artificial Sequence: Synthetic oligonucleotide
gcagctgctcaataaagact

SEQ ID NO: 9748 - DNA, 20 bp, Artificial Sequence
  Description of Artificial Sequence: Synthetic oligonucleotide
cagctgctcaataaagactt

SEQ ID NO: 9749 - DNA, 20 bp, Artificial Sequence
  Description of Artificial Sequence: Synthetic oligonucleotide
agctgctcaataaagacttg

SEQ ID NO: 9750 - DNA, 20 bp, Artificial Sequence
  Description of Artificial Sequence: Synthetic oligonucleotide
gctgctcaataaagacttga

SEQ ID NO: 9751 - DNA, 20 bp, Artificial Sequence
  Description of Artificial Sequence: Synthetic oligonucleotide
ctgctcaataaagacttgag

SEQ ID NO: 9752 - DNA, 20 bp, Artificial Sequence
  Description of Artificial Sequence: Synthetic oligonucleotide
tgctcaataaagacttgagg

SEQ ID NO: 9753 - DNA, 20 bp, Artificial Sequence
  Description of Artificial Sequence: Synthetic oligonucleotide
gctcaataaagacttgagga

SEQ ID NO: 9754 - DNA, 20 bp, Artificial Sequence
  Description of Artificial Sequence: Synthetic oligonucleotide
ctcaataaagacttgaggaa

SEQ ID NO: 9755 - DNA, 20 bp, Artificial Sequence
  Description of Artificial Sequence: Synthetic oligonucleotide
tcaataaagacttgaggaat

SEQ ID NO: 9756 - DNA, 20 bp, Artificial Sequence
  Description of Artificial Sequence: Synthetic oligonucleotide
caataaagacttgaggaatg

SEQ ID NO: 9757 - DNA, 20 bp, Artificial Sequence
  Description of Artificial Sequence: Synthetic oligonucleotide
aataaagacttgaggaatgg

SEQ ID NO: 9758 - DNA, 20 bp, Artificial Sequence
  Description of Artificial Sequence: Synthetic oligonucleotide
ataaagacttgaggaatggg

SEQ ID NO: 9759 - DNA, 20 bp, Artificial Sequence
  Description of Artificial Sequence: Synthetic oligonucleotide
taaagacttgaggaatgggc

SEQ ID NO: 9760 - DNA, 20 bp, Artificial Sequence
  Description of Artificial Sequence: Synthetic oligonucleotide
aaagacttgaggaatgggcc

SEQ ID NO: 9761 - DNA, 20 bp, Artificial Sequence
  Description of Artificial Sequence: Synthetic oligonucleotide
aagacttgaggaatgggccg

SEQ ID NO: 9762 - DNA, 20 bp, Artificial Sequence
  Description of Artificial Sequence: Synthetic oligonucleotide
agacttgaggaatgggccgg

SEQ ID NO: 9763 - DNA, 20 bp, Artificial Sequence
  Description of Artificial Sequence: Synthetic oligonucleotide
gacttgaggaatgggccggg

SEQ ID NO: 9764 - DNA, 20 bp, Artificial Sequence
  Description of Artificial Sequence: Synthetic oligonucleotide
acttgaggaatgggccgggc

SEQ ID NO: 9765 - DNA, 20 bp, Artificial Sequence
  Description of Artificial Sequence: Synthetic oligonucleotide
cttgaggaatgggccgggcg

SEQ ID NO: 9766 - DNA, 20 bp, Artificial Sequence
  Description of Artificial Sequence: Synthetic oligonucleotide
ttgaggaatgggccgggcgc

SEQ ID NO: 9767 - DNA, 20 bp, Artificial Sequence
  Description of Artificial Sequence: Synthetic oligonucleotide
tgaggaatgggccgggcgca

SEQ ID NO: 9768 - DNA, 20 bp, Artificial Sequence
  Description of Artificial Sequence: Synthetic oligonucleotide
gaggaatgggccgggcgcag

SEQ ID NO: 9769 - DNA, 20 bp, Artificial Sequence
  Description of Artificial Sequence: Synthetic oligonucleotide
aggaatgggccgggcgcagt

SEQ ID NO: 9770 - DNA, 20 bp, Artificial Sequence
  Description of Artificial Sequence: Synthetic oligonucleotide
ggaatgggccgggcgcagtg

SEQ ID NO: 9771 - DNA, 20 bp, Artificial Sequence
  Description of Artificial Sequence: Synthetic oligonucleotide
gaatgggccgggcgcagtgg

SEQ ID NO: 9772 - DNA, 20 bp, Artificial Sequence
  Description of Artificial Sequence: Synthetic oligonucleotide
aatgggccgggcgcagtggt

SEQ ID NO: 9773 - DNA, 20 bp, Artificial Sequence
  Description of Artificial Sequence: Synthetic oligonucleotide
atgggccgggcgcagtggtt

SEQ ID NO: 9774 - DNA, 20 bp, Artificial Sequence
  Description of Artificial Sequence: Synthetic oligonucleotide
tgggccgggcgcagtggttc

SEQ ID NO: 9775 - DNA, 20 bp, Artificial Sequence
  Description of Artificial Sequence: Synthetic oligonucleotide
gggccgggcgcagtggttca

SEQ ID NO: 9776 - DNA, 20 bp, Artificial Sequence
  Description of Artificial Sequence: Synthetic oligonucleotide
ggccgggcgcagtggttcat

SEQ ID NO: 9777 - DNA, 20 bp, Artificial Sequence
  Description of Artificial Sequence: Synthetic oligonucleotide
gccgggcgcagtggttcatg

SEQ ID NO: 9778 - DNA, 20 bp, Artificial Sequence
  Description of Artificial Sequence: Synthetic oligonucleotide
ccgggcgcagtggttcatgc

SEQ ID NO: 9779 - DNA, 20 bp, Artificial Sequence
  Description of Artificial Sequence: Synthetic oligonucleotide
cgggcgcagtggttcatgcc

SEQ ID NO: 9780 - DNA, 20 bp, Artificial Sequence
  Description of Artificial Sequence: Synthetic oligonucleotide
gggcgcagtggttcatgcct

SEQ ID NO: 9781 - DNA, 20 bp, Artificial Sequence
  Description of Artificial Sequence: Synthetic oligonucleotide
ggcgcagtggttcatgcctg

SEQ ID NO: 9782 - DNA, 20 bp, Artificial Sequence
  Description of Artificial Sequence: Synthetic oligonucleotide
gcgcagtggttcatgcctgt

SEQ ID NO: 9783 - DNA, 20 bp, Artificial Sequence
  Description of Artificial Sequence: Synthetic oligonucleotide
cgcagtggttcatgcctgta

SEQ ID NO: 9784 - DNA, 20 bp, Artificial Sequence
  Description of Artificial Sequence: Synthetic oligonucleotide
gcagtggttcatgcctgtaa

SEQ ID NO: 9785 - DNA, 20 bp, Artificial Sequence
  Description of Artificial Sequence: Synthetic oligonucleotide
cagtggttcatgcctgtaat

SEQ ID NO: 9786 - DNA, 20 bp, Artificial Sequence
  Description of Artificial Sequence: Synthetic oligonucleotide
agtggttcatgcctgtaatc

SEQ ID NO: 9787 - DNA, 20 bp, Artificial Sequence
  Description of Artificial Sequence: Synthetic oligonucleotide
gtggttcatgcctgtaatcc

SEQ ID NO: 9788 - DNA, 20 bp, Artificial Sequence
  Description of Artificial Sequence: Synthetic oligonucleotide
tggttcatgcctgtaatcca

SEQ ID NO: 9789 - DNA, 20 bp, Artificial Sequence
  Description of Artificial Sequence: Synthetic oligonucleotide
ggttcatgcctgtaatccag

SEQ ID NO: 9790 - DNA, 20 bp, Artificial Sequence
  Description of Artificial Sequence: Synthetic oligonucleotide
gttcatgcctgtaatccagc

SEQ ID NO: 9791 - DNA, 20 bp, Artificial Sequence
  Description of Artificial Sequence: Synthetic oligonucleotide
ttcatgcctgtaatccagca

SEQ ID NO: 9792 - DNA, 20 bp, Artificial Sequence
  Description of Artificial Sequence: Synthetic oligonucleotide
tcatgcctgtaatccagcac

SEQ ID NO: 9793 - DNA, 20 bp, Artificial Sequence
  Description of Artificial Sequence: Synthetic oligonucleotide
catgcctgtaatccagcact

SEQ ID NO: 9794 - DNA, 20 bp, Artificial Sequence
  Description of Artificial Sequence: Synthetic oligonucleotide
atgcctgtaatccagcactt

SEQ ID NO: 9795 - DNA, 20 bp, Artificial Sequence
  Description of Artificial Sequence: Synthetic oligonucleotide
tgcctgtaatccagcacttt

SEQ ID NO: 9796 - DNA, 20 bp, Artificial Sequence
  Description of Artificial Sequence: Synthetic oligonucleotide
gcctgtaatccagcactttg

SEQ ID NO: 9797 - DNA, 20 bp, Artificial Sequence
  Description of Artificial Sequence: Synthetic oligonucleotide
cctgtaatccagcactttgg

SEQ ID NO: 9798 - DNA, 20 bp, Artificial Sequence
  Description of Artificial Sequence: Synthetic oligonucleotide
ctgtaatccagcactttggg

SEQ ID NO: 9799 - DNA, 20 bp, Artificial Sequence
  Description of Artificial Sequence: Synthetic oligonucleotide
tgtaatccagcactttggga

SEQ ID NO: 9800 - DNA, 20 bp, Artificial Sequence
  Description of Artificial Sequence: Synthetic oligonucleotide
gtaatccagcactttgggag

SEQ ID NO: 9801 - DNA, 20 bp, Artificial Sequence
  Description of Artificial Sequence: Synthetic oligonucleotide
taatccagcactttgggagg

SEQ ID NO: 9802 - DNA, 20 bp, Artificial Sequence
  Description of Artificial Sequence: Synthetic oligonucleotide
aatccagcactttgggaggc

SEQ ID NO: 9803 - DNA, 20 bp, Artificial Sequence
  Description of Artificial Sequence: Synthetic oligonucleotide
atccagcactttgggaggcg

SEQ ID NO: 9804 - DNA, 20 bp, Artificial Sequence
  Description of Artificial Sequence: Synthetic oligonucleotide
tccagcactttgggaggcgg

SEQ ID NO: 9805 - DNA, 20 bp, Artificial Sequence
  Description of Artificial Sequence: Synthetic oligonucleotide
ccagcactttgggaggcggg

SEQ ID NO: 9806 - DNA, 20 bp, Artificial Sequence
  Description of Artificial Sequence: Synthetic oligonucleotide
cagcactttgggaggcgggc

SEQ ID NO: 9807 - DNA, 20 bp, Artificial Sequence
  Description of Artificial Sequence: Synthetic oligonucleotide
agcactttgggaggcgggcg

SEQ ID NO: 9808 - DNA, 20 bp, Artificial Sequence
  Description of Artificial Sequence: Synthetic oligonucleotide
gcactttgggaggcgggcgg

SEQ ID NO: 9809 - DNA, 20 bp, Artificial Sequence
  Description of Artificial Sequence: Synthetic oligonucleotide
cactttgggaggcgggcgga

SEQ ID NO: 9810 - DNA, 20 bp, Artificial Sequence
  Description of Artificial Sequence: Synthetic oligonucleotide
actttgggaggcgggcggat

SEQ ID NO: 9811 - DNA, 20 bp, Artificial Sequence
  Description of Artificial Sequence: Synthetic oligonucleotide
ctttgggaggcgggcggatc

SEQ ID NO: 9812 - DNA, 20 bp, Artificial Sequence
  Description of Artificial Sequence: Synthetic oligonucleotide
tttgggaggcgggcggatcg

SEQ ID NO: 9813 - DNA, 20 bp, Artificial Sequence
  Description of Artificial Sequence: Synthetic oligonucleotide
ttgggaggcgggcggatcgg

SEQ ID NO: 9814 - DNA, 20 bp, Artificial Sequence
  Description of Artificial Sequence: Synthetic oligonucleotide
tgggaggcgggcggatcggt

SEQ ID NO: 9815 - DNA, 20 bp, Artificial Sequence
  Description of Artificial Sequence: Synthetic oligonucleotide
gggaggcgggcggatcggtc

SEQ ID NO: 9816 - DNA, 20 bp, Artificial Sequence
  Description of Artificial Sequence: Synthetic oligonucleotide
ggaggcgggcggatcggtca

SEQ ID NO: 9817 - DNA, 20 bp, Artificial Sequence
  Description of Artificial Sequence: Synthetic oligonucleotide
gaggcgggcggatcggtcag

SEQ ID NO: 9818 - DNA, 20 bp, Artificial Sequence
  Description of Artificial Sequence: Synthetic oligonucleotide
aggcgggcggatcggtcagg

SEQ ID NO: 9819 - DNA, 20 bp, Artificial Sequence
  Description of Artificial Sequence: Synthetic oligonucleotide
ggcgggcggatcggtcagga

SEQ ID NO: 9820 - DNA, 20 bp, Artificial Sequence
  Description of Artificial Sequence: Synthetic oligonucleotide
gcgggcggatcggtcaggag

SEQ ID NO: 9821 - DNA, 20 bp, Artificial Sequence
  Description of Artificial Sequence: Synthetic oligonucleotide
cgggcggatcggtcaggagt

SEQ ID NO: 9822 - DNA, 20 bp, Artificial Sequence
  Description of Artificial Sequence: Synthetic oligonucleotide
gggcggatcggtcaggagtt

SEQ ID NO: 9823 - DNA, 20 bp, Artificial Sequence
  Description of Artificial Sequence: Synthetic oligonucleotide
ggcggatcggtcaggagttt

SEQ ID NO: 9824 - DNA, 20 bp, Artificial Sequence
  Description of Artificial Sequence: Synthetic oligonucleotide
gcggatcggtcaggagtttg

SEQ ID NO: 9825 - DNA, 20 bp, Artificial Sequence
  Description of Artificial Sequence: Synthetic oligonucleotide
cggatcggtcaggagtttga

SEQ ID NO: 9826 - DNA, 20 bp, Artificial Sequence
  Description of Artificial Sequence: Synthetic oligonucleotide
ggatcggtcaggagtttgag

SEQ ID NO: 9827 - DNA, 20 bp, Artificial Sequence
  Description of Artificial Sequence: Synthetic oligonucleotide
gatcggtcaggagtttgaga

SEQ ID NO: 9828 - DNA, 20 bp, Artificial Sequence
  Description of Artificial Sequence: Synthetic oligonucleotide
atcggtcaggagtttgagac

SEQ ID NO: 9829 - DNA, 20 bp, Artificial Sequence
  Description of Artificial Sequence: Synthetic oligonucleotide
tcggtcaggagtttgagacc

SEQ ID NO: 9830 - DNA, 20 bp, Artificial Sequence
  Description of Artificial Sequence: Synthetic oligonucleotide
cggtcaggagtttgagacca

SEQ ID NO: 9831 - DNA, 20 bp, Artificial Sequence
  Description of Artificial Sequence: Synthetic oligonucleotide
ggtcaggagtttgagaccag

SEQ ID NO: 9832 - DNA, 20 bp, Artificial Sequence
  Description of Artificial Sequence: Synthetic oligonucleotide
gtcaggagtttgagaccagc

SEQ ID NO: 9833 - DNA, 20 bp, Artificial Sequence
  Description of Artificial Sequence: Synthetic oligonucleotide
tcaggagtttgagaccagcc

SEQ ID NO: 9834 - DNA, 20 bp, Artificial Sequence
  Description of Artificial Sequence: Synthetic oligonucleotide
caggagtttgagaccagcct

SEQ ID NO: 9835 - DNA, 20 bp, Artificial Sequence
  Description of Artificial Sequence: Synthetic oligonucleotide
aggagtttgagaccagcctg

SEQ ID NO: 9836 - DNA, 20 bp, Artificial Sequence
  Description of Artificial Sequence: Synthetic oligonucleotide
ggagtttgagaccagcctgg

SEQ ID NO: 9837 - DNA, 20 bp, Artificial Sequence
  Description of Artificial Sequence: Synthetic oligonucleotide
gagtttgagaccagcctggt

SEQ ID NO: 9838 - DNA, 20 bp, Artificial Sequence
  Description of Artificial Sequence: Synthetic oligonucleotide
agtttgagaccagcctggtc

SEQ ID NO: 9839 - DNA, 20 bp, Artificial Sequence
  Description of Artificial Sequence: Synthetic oligonucleotide
gtttgagaccagcctggtca

SEQ ID NO: 9840 - DNA, 20 bp, Artificial Sequence
  Description of Artificial Sequence: Synthetic oligonucleotide
tttgagaccagcctggtcaa

SEQ ID NO: 9841 - DNA, 20 bp, Artificial Sequence
  Description of Artificial Sequence: Synthetic oligonucleotide
ttgagaccagcctggtcaac

SEQ ID NO: 9842 - DNA, 20 bp, Artificial Sequence
  Description of Artificial Sequence: Synthetic oligonucleotide
tgagaccagcctggtcaaca

SEQ ID NO: 9843 - DNA, 20 bp, Artificial Sequence
  Description of Artificial Sequence: Synthetic oligonucleotide
gagaccagcctggtcaacat

SEQ ID NO: 9844 - DNA, 20 bp, Artificial Sequence
  Description of Artificial Sequence: Synthetic oligonucleotide
agaccagcctggtcaacatg

SEQ ID NO: 9845 - DNA, 20 bp, Artificial Sequence
  Description of Artificial Sequence: Synthetic oligonucleotide
gaccagcctggtcaacatgg

SEQ ID NO: 9846 - DNA, 20 bp, Artificial Sequence
  Description of Artificial Sequence: Synthetic oligonucleotide
accagcctggtcaacatggc

SEQ ID NO: 9847 - DNA, 20 bp, Artificial Sequence
  Description of Artificial Sequence: Synthetic oligonucleotide
ccagcctggtcaacatggcc

SEQ ID NO: 9848 - DNA, 20 bp, Artificial Sequence
  Description of Artificial Sequence: Synthetic oligonucleotide
cagcctggtcaacatggcca

SEQ ID NO: 9849 - DNA, 20 bp, Artificial Sequence
  Description of Artificial Sequence: Synthetic oligonucleotide
agcctggtcaacatggccaa

SEQ ID NO: 9850 - DNA, 20 bp, Artificial Sequence
  Description of Artificial Sequence: Synthetic oligonucleotide
gcctggtcaacatggccaaa

SEQ ID NO: 9851 - DNA, 20 bp, Artificial Sequence
  Description of Artificial Sequence: Synthetic oligonucleotide
cctggtcaacatggccaaac

SEQ ID NO: 9852 - DNA, 20 bp, Artificial Sequence
  Description of Artificial Sequence: Synthetic oligonucleotide
ctggtcaacatggccaaacc

SEQ ID NO: 9853 - DNA, 20 bp, Artificial Sequence
  Description of Artificial Sequence: Synthetic oligonucleotide
tggtcaacatggccaaaccc

SEQ ID NO: 9854 - DNA, 20 bp, Artificial Sequence
  Description of Artificial Sequence: Synthetic oligonucleotide
ggtcaacatggccaaacccc

SEQ ID NO: 9855 - DNA, 20 bp, Artificial Sequence
  Description of Artificial Sequence: Synthetic oligonucleotide
gtcaacatggccaaacccca

SEQ ID NO: 9856 - DNA, 20 bp, Artificial Sequence
  Description of Artificial Sequence: Synthetic oligonucleotide
tcaacatggccaaaccccat

SEQ ID NO: 9857 - DNA, 20 bp, Artificial Sequence
  Description of Artificial Sequence: Synthetic oligonucleotide
caacatggccaaaccccatc

SEQ ID NO: 9858 - DNA, 20 bp, Artificial Sequence
  Description of Artificial Sequence: Synthetic oligonucleotide
aacatggccaaaccccatct

SEQ ID NO: 9859 - DNA, 20 bp, Artificial Sequence
  Description of Artificial Sequence: Synthetic oligonucleotide
acatggccaaaccccatctc

SEQ ID NO: 9860 - DNA, 20 bp, Artificial Sequence
  Description of Artificial Sequence: Synthetic oligonucleotide
catggccaaaccccatctct

SEQ ID NO: 9861 - DNA, 20 bp, Artificial Sequence
  Description of Artificial Sequence: Synthetic oligonucleotide
atggccaaaccccatctcta

SEQ ID NO: 9862 - DNA, 20 bp, Artificial Sequence
  Description of Artificial Sequence: Synthetic oligonucleotide
tggccaaaccccatctctag

SEQ ID NO: 9863 - DNA, 20 bp, Artificial Sequence
  Description of Artificial Sequence: Synthetic oligonucleotide
ggccaaaccccatctctagt

SEQ ID NO: 9864 - DNA, 20 bp, Artificial Sequence
  Description of Artificial Sequence: Synthetic oligonucleotide
gccaaaccccatctctagta

SEQ ID NO: 9865 - DNA, 20 bp, Artificial Sequence
  Description of Artificial Sequence: Synthetic oligonucleotide
ccaaaccccatctctagtaa

SEQ ID NO: 9866 - DNA, 20 bp, Artificial Sequence
  Description of Artificial Sequence: Synthetic oligonucleotide
caaaccccatctctagtaaa

SEQ ID NO: 9867 - DNA, 20 bp, Artificial Sequence
  Description of Artificial Sequence: Synthetic oligonucleotide
aaaccccatctctagtaaaa

SEQ ID NO: 9868 - DNA, 20 bp, Artificial Sequence
  Description of Artificial Sequence: Synthetic oligonucleotide
aaccccatctctagtaaaac

SEQ ID NO: 9869 - DNA, 20 bp, Artificial Sequence
  Description of Artificial Sequence: Synthetic oligonucleotide
accccatctctagtaaaaca

SEQ ID NO: 9870 - DNA, 20 bp, Artificial Sequence
  Description of Artificial Sequence: Synthetic oligonucleotide
ccccatctctagtaaaacat

SEQ ID NO: 9871 - DNA, 20 bp, Artificial Sequence
  Description of Artificial Sequence: Synthetic oligonucleotide
cccatctctagtaaaacata

SEQ ID NO: 9872 - DNA, 20 bp, Artificial Sequence
  Description of Artificial Sequence: Synthetic oligonucleotide
ccatctctagtaaaacatac

SEQ ID NO: 9873 - DNA, 20 bp, Artificial Sequence
  Description of Artificial Sequence: Synthetic oligonucleotide
catctctagtaaaacataca

SEQ ID NO: 9874 - DNA, 20 bp, Artificial Sequence
  Description of Artificial Sequence: Synthetic oligonucleotide
atctctagtaaaacatacaa

SEQ ID NO: 9875 - DNA, 20 bp, Artificial Sequence
  Description of Artificial Sequence: Synthetic oligonucleotide
tctctagtaaaacatacaaa

SEQ ID NO: 9876 - DNA, 20 bp, Artificial Sequence
  Description of Artificial Sequence: Synthetic oligonucleotide
ctctagtaaaacatacaaag

SEQ ID NO: 9877 - DNA, 20 bp, Artificial Sequence
  Description of Artificial Sequence: Synthetic oligonucleotide
tctagtaaaacatacaaaga

SEQ ID NO: 9878 - DNA, 20 bp, Artificial Sequence
  Description of Artificial Sequence: Synthetic oligonucleotide
ctagtaaaacatacaaagat

SEQ ID NO: 9879 - DNA, 20 bp, Artificial Sequence
  Description of Artificial Sequence: Synthetic oligonucleotide
tagtaaaacatacaaagatt

SEQ ID NO: 9880 - DNA, 20 bp, Artificial Sequence
  Description of Artificial Sequence: Synthetic oligonucleotide
agtaaaacatacaaagatta

SEQ ID NO: 9881 - DNA, 20 bp, Artificial Sequence
  Description of Artificial Sequence: Synthetic oligonucleotide
gtaaaacatacaaagattag

SEQ ID NO: 9882 - DNA, 20 bp, Artificial Sequence
  Description of Artificial Sequence: Synthetic oligonucleotide
taaaacatacaaagattagc

SEQ ID NO: 9883 - DNA, 20 bp, Artificial Sequence
  Description of Artificial Sequence: Synthetic oligonucleotide
aaaacatacaaagattagct

SEQ ID NO: 9884 - DNA, 20 bp, Artificial Sequence
  Description of Artificial Sequence: Synthetic oligonucleotide
aaacatacaaagattagctg

SEQ ID NO: 9885 - DNA, 20 bp, Artificial Sequence
  Description of Artificial Sequence: Synthetic oligonucleotide
aacatacaaagattagctgg

SEQ ID NO: 9886 - DNA, 20 bp, Artificial Sequence
  Description of Artificial Sequence: Synthetic oligonucleotide
acatacaaagattagctggg

SEQ ID NO: 9887 - DNA, 20 bp, Artificial Sequence
  Description of Artificial Sequence: Synthetic oligonucleotide
catacaaagattagctgggt

SEQ ID NO: 9888 - DNA, 20 bp, Artificial Sequence
  Description of Artificial Sequence: Synthetic oligonucleotide
atacaaagattagctgggtg

SEQ ID NO: 9889 - DNA, 20 bp, Artificial Sequence
  Description of Artificial Sequence: Synthetic oligonucleotide
tacaaagattagctgggtgt

SEQ ID NO: 9890 - DNA, 20 bp, Artificial Sequence
  Description of Artificial Sequence: Synthetic oligonucleotide
acaaagattagctgggtgtg

SEQ ID NO: 9891 - DNA, 20 bp, Artificial Sequence
  Description of Artificial Sequence: Synthetic oligonucleotide
caaagattagctgggtgtga

SEQ ID NO: 9892 - DNA, 20 bp, Artificial Sequence
  Description of Artificial Sequence: Synthetic oligonucleotide
aaagattagctgggtgtgat

SEQ ID NO: 9893 - DNA, 20 bp, Artificial Sequence
  Description of Artificial Sequence: Synthetic oligonucleotide
aagattagctgggtgtgatg

SEQ ID NO: 9894 - DNA, 20 bp, Artificial Sequence
  Description of Artificial Sequence: Synthetic oligonucleotide
agattagctgggtgtgatgg

SEQ ID NO: 9895 - DNA, 20 bp, Artificial Sequence
  Description of Artificial Sequence: Synthetic oligonucleotide
gattagctgggtgtgatggt

SEQ ID NO: 9896 - DNA, 20 bp, Artificial Sequence
  Description of Artificial Sequence: Synthetic oligonucleotide
attagctgggtgtgatggtg

SEQ ID NO: 9897 - DNA, 20 bp, Artificial Sequence
  Description of Artificial Sequence: Synthetic oligonucleotide
ttagctgggtgtgatggtgg

SEQ ID NO: 9898 - DNA, 20 bp, Artificial Sequence
  Description of Artificial Sequence: Synthetic oligonucleotide
tagctgggtgtgatggtgga

SEQ ID NO: 9899 - DNA, 20 bp, Artificial Sequence
  Description of Artificial Sequence: Synthetic oligonucleotide
agctgggtgtgatggtggac

SEQ ID NO: 9900 - DNA, 20 bp, Artificial Sequence
  Description of Artificial Sequence: Synthetic oligonucleotide
gctgggtgtgatggtggacg

SEQ ID NO: 9901 - DNA, 20 bp, Artificial Sequence
  Description of Artificial Sequence: Synthetic oligonucleotide
ctgggtgtgatggtggacgc

SEQ ID NO: 9902 - DNA, 20 bp, Artificial Sequence
  Description of Artificial Sequence: Synthetic oligonucleotide
tgggtgtgatggtggacgcc

SEQ ID NO: 9903 - DNA, 20 bp, Artificial Sequence
  Description of Artificial Sequence: Synthetic oligonucleotide
gggtgtgatggtggacgcca

SEQ ID NO: 9904 - DNA, 20 bp, Artificial Sequence
  Description of Artificial Sequence: Synthetic oligonucleotide
ggtgtgatggtggacgccag

SEQ ID NO: 9905 - DNA, 20 bp, Artificial Sequence
  Description of Artificial Sequence: Synthetic oligonucleotide
gtgtgatggtggacgccagt

SEQ ID NO: 9906 - DNA, 20 bp, Artificial Sequence
  Description of Artificial Sequence: Synthetic oligonucleotide
tgtgatggtggacgccagta

SEQ ID NO: 9907 - DNA, 20 bp, Artificial Sequence
  Description of Artificial Sequence: Synthetic oligonucleotide
gtgatggtggacgccagtaa

SEQ ID NO: 9908 - DNA, 20 bp, Artificial Sequence
  Description of Artificial Sequence: Synthetic oligonucleotide
tgatggtggacgccagtaat

SEQ ID NO: 9909 - DNA, 20 bp, Artificial Sequence
  Description of Artificial Sequence: Synthetic oligonucleotide
gatggtggacgccagtaatc

SEQ ID NO: 9910 - DNA, 20 bp, Artificial Sequence
  Description of Artificial Sequence: Synthetic oligonucleotide
atggtggacgccagtaatcc

SEQ ID NO: 9911 - DNA, 20 bp, Artificial Sequence
  Description of Artificial Sequence: Synthetic oligonucleotide
tggtggacgccagtaatccc

SEQ ID NO: 9912 - DNA, 20 bp, Artificial Sequence
  Description of Artificial Sequence: Synthetic oligonucleotide
ggtggacgccagtaatccca

SEQ ID NO: 9913 - DNA, 20 bp, Artificial Sequence
  Description of Artificial Sequence: Synthetic oligonucleotide
gtggacgccagtaatcccag

SEQ ID NO: 9914 - DNA, 20 bp, Artificial Sequence
  Description of Artificial Sequence: Synthetic oligonucleotide
tggacgccagtaatcccagc

SEQ ID NO: 9915 - DNA, 20 bp, Artificial Sequence
  Description of Artificial Sequence: Synthetic oligonucleotide
ggacgccagtaatcccagct

SEQ ID NO: 9916 - DNA, 20 bp, Artificial Sequence
  Description of Artificial Sequence: Synthetic oligonucleotide
gacgccagtaatcccagctc

SEQ ID NO: 9917 - DNA, 20 bp, Artificial Sequence
  Description of Artificial Sequence: Synthetic oligonucleotide
acgccagtaatcccagctcc

SEQ ID NO: 9918 - DNA, 20 bp, Artificial Sequence
  Description of Artificial Sequence: Synthetic oligonucleotide
cgccagtaatcccagctcct

SEQ ID NO: 9919 - DNA, 20 bp, Artificial Sequence
  Description of Artificial Sequence: Synthetic oligonucleotide
gccagtaatcccagctcctt

SEQ ID NO: 9920 - DNA, 20 bp, Artificial Sequence
  Description of Artificial Sequence: Synthetic oligonucleotide
ccagtaatcccagctcctta

SEQ ID NO: 9921 - DNA, 20 bp, Artificial Sequence
  Description of Artificial Sequence: Synthetic oligonucleotide
cagtaatcccagctccttag

SEQ ID NO: 9922 - DNA, 20 bp, Artificial Sequence
  Description of Artificial Sequence: Synthetic oligonucleotide
agtaatcccagctccttagg

SEQ ID NO: 9923 - DNA, 20 bp, Artificial Sequence
  Description of Artificial Sequence: Synthetic oligonucleotide
gtaatcccagctccttagga

SEQ ID NO: 9924 - DNA, 20 bp, Artificial Sequence
  Description of Artificial Sequence: Synthetic oligonucleotide
taatcccagctccttaggag

SEQ ID NO: 9925 - DNA, 20 bp, Artificial Sequence
  Description of Artificial Sequence: Synthetic oligonucleotide
aatcccagctccttaggagg

SEQ ID NO: 9926 - DNA, 20 bp, Artificial Sequence
  Description of Artificial Sequence: Synthetic oligonucleotide
atcccagctccttaggaggc

SEQ ID NO: 9927 - DNA, 20 bp, Artificial Sequence
  Description of Artificial Sequence: Synthetic oligonucleotide
tcccagctccttaggaggca

SEQ ID NO: 9928 - DNA, 20 bp, Artificial Sequence
  Description of Artificial Sequence: Synthetic oligonucleotide
cccagctccttaggaggcag

SEQ ID NO: 9929 - DNA, 20 bp, Artificial Sequence
  Description of Artificial Sequence: Synthetic oligonucleotide
ccagctccttaggaggcaga

SEQ ID NO: 9930 - DNA, 20 bp, Artificial Sequence
  Description of Artificial Sequence: Synthetic oligonucleotide
cagctccttaggaggcagag

SEQ ID NO: 9931 - DNA, 20 bp, Artificial Sequence
  Description of Artificial Sequence: Synthetic oligonucleotide
agctccttaggaggcagagg

SEQ ID NO: 9932 - DNA, 20 bp, Artificial Sequence
  Description of Artificial Sequence: Synthetic oligonucleotide
gctccttaggaggcagaggc

SEQ ID NO: 9933 - DNA, 20 bp, Artificial Sequence
  Description of Artificial Sequence: Synthetic oligonucleotide
ctccttaggaggcagaggca

SEQ ID NO: 9934 - DNA, 20 bp, Artificial Sequence
  Description of Artificial Sequence: Synthetic oligonucleotide
tccttaggaggcagaggcag

SEQ ID NO: 9935 - DNA, 20 bp, Artificial Sequence
  Description of Artificial Sequence: Synthetic oligonucleotide
ccttaggaggcagaggcagg

SEQ ID NO: 9936 - DNA, 20 bp, Artificial Sequence
  Description of Artificial Sequence: Synthetic oligonucleotide
cttaggaggcagaggcagga

SEQ ID NO: 9937 - DNA, 20 bp, Artificial Sequence
  Description of Artificial Sequence: Synthetic oligonucleotide
ttaggaggcagaggcaggag

SEQ ID NO: 9938 - DNA, 20 bp, Artificial Sequence
  Description of Artificial Sequence: Synthetic oligonucleotide
taggaggcagaggcaggaga

SEQ ID NO: 9939 - DNA, 20 bp, Artificial Sequence
  Description of Artificial Sequence: Synthetic oligonucleotide
aggaggcagaggcaggagaa

SEQ ID NO: 9940 - DNA, 20 bp, Artificial Sequence
  Description of Artificial Sequence: Synthetic oligonucleotide
ggaggcagaggcaggagaat

SEQ ID NO: 9941 - DNA, 20 bp, Artificial Sequence
  Description of Artificial Sequence: Synthetic oligonucleotide
gaggcagaggcaggagaatc

SEQ ID NO: 9942 - DNA, 20 bp, Artificial Sequence
  Description of Artificial Sequence: Synthetic oligonucleotide
aggcagaggcaggagaatca

SEQ ID NO: 9943 - DNA, 20 bp, Artificial Sequence
  Description of Artificial Sequence: Synthetic oligonucleotide
ggcagaggcaggagaatcac

SEQ ID NO: 9944 - DNA, 20 bp, Artificial Sequence
  Description of Artificial Sequence: Synthetic oligonucleotide
gcagaggcaggagaatcact

SEQ ID NO: 9945 - DNA, 20 bp, Artificial Sequence
  Description of Artificial Sequence: Synthetic oligonucleotide
cagaggcaggagaatcactt

SEQ ID NO: 9946 - DNA, 20 bp, Artificial Sequence
  Description of Artificial Sequence: Synthetic oligonucleotide
agaggcaggagaatcacttg

SEQ ID NO: 9947 - DNA, 20 bp, Artificial Sequence
  Description of Artificial Sequence: Synthetic oligonucleotide
gaggcaggagaatcacttga

SEQ ID NO: 9948 - DNA, 20 bp, Artificial Sequence
  Description of Artificial Sequence: Synthetic oligonucleotide
aggcaggagaatcacttgaa

SEQ ID NO: 9949 - DNA, 20 bp, Artificial Sequence
  Description of Artificial Sequence: Synthetic oligonucleotide
ggcaggagaatcacttgaac

SEQ ID NO: 9950 - DNA, 20 bp, Artificial Sequence
  Description of Artificial Sequence: Synthetic oligonucleotide
gcaggagaatcacttgaacc

SEQ ID NO: 9951 - DNA, 20 bp, Artificial Sequence
  Description of Artificial Sequence: Synthetic oligonucleotide
caggagaatcacttgaaccc

SEQ ID NO: 9952 - DNA, 20 bp, Artificial Sequence
  Description of Artificial Sequence: Synthetic oligonucleotide
aggagaatcacttgaacccg

SEQ ID NO: 9953 - DNA, 20 bp, Artificial Sequence
  Description of Artificial Sequence: Synthetic oligonucleotide
ggagaatcacttgaacccgg

SEQ ID NO: 9954 - DNA, 20 bp, Artificial Sequence
  Description of Artificial Sequence: Synthetic oligonucleotide
gagaatcacttgaacccggg

SEQ ID NO: 9955 - DNA, 20 bp, Artificial Sequence
  Description of Artificial Sequence: Synthetic oligonucleotide
agaatcacttgaacccggga

SEQ ID NO: 9956 - DNA, 20 bp, Artificial Sequence
  Description of Artificial Sequence: Synthetic oligonucleotide
gaatcacttgaacccgggag

SEQ ID NO: 9957 - DNA, 20 bp, Artificial Sequence
  Description of Artificial Sequence: Synthetic oligonucleotide
aatcacttgaacccgggagg

SEQ ID NO: 9958 - DNA, 20 bp, Artificial Sequence
  Description of Artificial Sequence: Synthetic oligonucleotide
atcacttgaacccgggaggc

SEQ ID NO: 9959 - DNA, 20 bp, Artificial Sequence
  Description of Artificial Sequence: Synthetic oligonucleotide
tcacttgaacccgggaggca

SEQ ID NO: 9960 - DNA, 20 bp, Artificial Sequence
  Description of Artificial Sequence: Synthetic oligonucleotide
cacttgaacccgggaggcag

SEQ ID NO: 9961 - DNA, 20 bp, Artificial Sequence
  Description of Artificial Sequence: Synthetic oligonucleotide
acttgaacccgggaggcaga

SEQ ID NO: 9962 - DNA, 20 bp, Artificial Sequence
  Description of Artificial Sequence: Synthetic oligonucleotide
cttgaacccgggaggcagag

SEQ ID NO: 9963 - DNA, 20 bp, Artificial Sequence
  Description of Artificial Sequence: Synthetic oligonucleotide
ttgaacccgggaggcagagg

SEQ ID NO: 9964 - DNA, 20 bp, Artificial Sequence
  Description of Artificial Sequence: Synthetic oligonucleotide
tgaacccgggaggcagaggt

SEQ ID NO: 9965 - DNA, 20 bp, Artificial Sequence
  Description of Artificial Sequence: Synthetic oligonucleotide
gaacccgggaggcagaggtt

SEQ ID NO: 9966 - DNA, 20 bp, Artificial Sequence
  Description of Artificial Sequence: Synthetic oligonucleotide
aacccgggaggcagaggttg

SEQ ID NO: 9967 - DNA, 20 bp, Artificial Sequence
  Description of Artificial Sequence: Synthetic oligonucleotide
acccgggaggcagaggttgc

SEQ ID NO: 9968 - DNA, 20 bp, Artificial Sequence
  Description of Artificial Sequence: Synthetic oligonucleotide
cccgggaggcagaggttgca

SEQ ID NO: 9969 - DNA, 20 bp, Artificial Sequence
  Description of Artificial Sequence: Synthetic oligonucleotide
ccgggaggcagaggttgcag

SEQ ID NO: 9970 - DNA, 20 bp, Artificial Sequence
  Description of Artificial Sequence: Synthetic oligonucleotide
cgggaggcagaggttgcagt

SEQ ID NO: 9971 - DNA, 20 bp, Artificial Sequence
  Description of Artificial Sequence: Synthetic oligonucleotide
gggaggcagaggttgcagtc

SEQ ID NO: 9972 - DNA, 20 bp, Artificial Sequence
  Description of Artificial Sequence: Synthetic oligonucleotide
ggaggcagaggttgcagtca

SEQ ID NO: 9973 - DNA, 20 bp, Artificial Sequence
  Description of Artificial Sequence: Synthetic oligonucleotide
gaggcagaggttgcagtcag

SEQ ID NO: 9974 - DNA, 20 bp, Artificial Sequence
  Description of Artificial Sequence: Synthetic oligonucleotide
aggcagaggttgcagtcagc

SEQ ID NO: 9975 - DNA, 20 bp, Artificial Sequence
  Description of Artificial Sequence: Synthetic oligonucleotide
ggcagaggttgcagtcagct

SEQ ID NO: 9976 - DNA, 20 bp, Artificial Sequence
  Description of Artificial Sequence: Synthetic oligonucleotide
gcagaggttgcagtcagctg

SEQ ID NO: 9977 - DNA, 20 bp, Artificial Sequence
  Description of Artificial Sequence: Synthetic oligonucleotide
cagaggttgcagtcagctga

SEQ ID NO: 9978 - DNA, 20 bp, Artificial Sequence
  Description of Artificial Sequence: Synthetic oligonucleotide
agaggttgcagtcagctgag

SEQ ID NO: 9979 - DNA, 20 bp, Artificial Sequence
  Description of Artificial Sequence: Synthetic oligonucleotide
gaggttgcagtcagctgagg

SEQ ID NO: 9980 - DNA, 20 bp, Artificial Sequence
  Description of Artificial Sequence: Synthetic oligonucleotide
aggttgcagtcagctgaggt

SEQ ID NO: 9981 - DNA, 20 bp, Artificial Sequence
  Description of Artificial Sequence: Synthetic oligonucleotide
ggttgcagtcagctgaggtt

SEQ ID NO: 9982 - DNA, 20 bp, Artificial Sequence
  Description of Artificial Sequence: Synthetic oligonucleotide
gttgcagtcagctgaggttg

SEQ ID NO: 9983 - DNA, 20 bp, Artificial Sequence
  Description of Artificial Sequence: Synthetic oligonucleotide
ttgcagtcagctgaggttga

SEQ ID NO: 9984 - DNA, 20 bp, Artificial Sequence
  Description of Artificial Sequence: Synthetic oligonucleotide
tgcagtcagctgaggttgaa

SEQ ID NO: 9985 - DNA, 20 bp, Artificial Sequence
  Description of Artificial Sequence: Synthetic oligonucleotide
gcagtcagctgaggttgaac

SEQ ID NO: 9986 - DNA, 20 bp, Artificial Sequence
  Description of Artificial Sequence: Synthetic oligonucleotide
cagtcagctgaggttgaacc

SEQ ID NO: 9987 - DNA, 20 bp, Artificial Sequence
  Description of Artificial Sequence: Synthetic oligonucleotide
agtcagctgaggttgaacca

SEQ ID NO: 9988 - DNA, 20 bp, Artificial Sequence
  Description of Artificial Sequence: Synthetic oligonucleotide
gtcagctgaggttgaaccat

SEQ ID NO: 9989 - DNA, 20 bp, Artificial Sequence
  Description of Artificial Sequence: Synthetic oligonucleotide
tcagctgaggttgaaccatt

SEQ ID NO: 9990 - DNA, 20 bp, Artificial Sequence
  Description of Artificial Sequence: Synthetic oligonucleotide
cagctgaggttgaaccattg

SEQ ID NO: 9991 - DNA, 20 bp, Artificial Sequence
  Description of Artificial Sequence: Synthetic oligonucleotide
agctgaggttgaaccattgc

SEQ ID NO: 9992 - DNA, 20 bp, Artificial Sequence
  Description of Artificial Sequence: Synthetic oligonucleotide
gctgaggttgaaccattgca

SEQ ID NO: 9993 - DNA, 20 bp, Artificial Sequence
  Description of Artificial Sequence: Synthetic oligonucleotide
ctgaggttgaaccattgcac

SEQ ID NO: 9994 - DNA, 20 bp, Artificial Sequence
  Description of Artificial Sequence: Synthetic oligonucleotide
tgaggttgaaccattgcact

SEQ ID NO: 9995 - DNA, 20 bp, Artificial Sequence
  Description of Artificial Sequence: Synthetic oligonucleotide
gaggttgaaccattgcactc

SEQ ID NO: 9996 - DNA, 20 bp, Artificial Sequence
  Description of Artificial Sequence: Synthetic oligonucleotide
aggttgaaccattgcactcc

SEQ ID NO: 9997 - DNA, 20 bp, Artificial Sequence
  Description of Artificial Sequence: Synthetic oligonucleotide
ggttgaaccattgcactcca

SEQ ID NO: 9998 - DNA, 20 bp, Artificial Sequence
  Description of Artificial Sequence: Synthetic oligonucleotide
gttgaaccattgcactccaa

SEQ ID NO: 9999 - DNA, 20 bp, Artificial Sequence
  Description of Artificial Sequence: Synthetic oligonucleotide
ttgaaccattgcactccaac

SEQ ID NO: 10000 - DNA, 20 bp, Artificial Sequence
  Description of Artificial Sequence: Synthetic oligonucleotide
tgaaccattgcactccaacc

SEQ ID NO: 10001 - DNA, 20 bp, Artificial Sequence
  Description of Artificial Sequence: Synthetic oligonucleotide
gaaccattgcactccaacct

SEQ ID NO: 10002 - DNA, 20 bp, Artificial Sequence
  Description of Artificial Sequence: Synthetic oligonucleotide
aaccattgcactccaacctg

SEQ ID NO: 10003 - DNA, 20 bp, Artificial Sequence
  Description of Artificial Sequence: Synthetic oligonucleotide
accattgcactccaacctgg

SEQ ID NO: 10004 - DNA, 20 bp, Artificial Sequence
  Description of Artificial Sequence: Synthetic oligonucleotide
ccattgcactccaacctggg

SEQ ID NO: 10005 - DNA, 20 bp, Artificial Sequence
  Description of Artificial Sequence: Synthetic oligonucleotide
cattgcactccaacctgggt

SEQ ID NO: 10006 - DNA, 20 bp, Artificial Sequence
  Description of Artificial Sequence: Synthetic oligonucleotide
attgcactccaacctgggtg

SEQ ID NO: 10007 - DNA, 20 bp, Artificial Sequence
  Description of Artificial Sequence: Synthetic oligonucleotide
ttgcactccaacctgggtga

SEQ ID NO: 10008 - DNA, 20 bp, Artificial Sequence
  Description of Artificial Sequence: Synthetic oligonucleotide
tgcactccaacctgggtgac

SEQ ID NO: 10009 - DNA, 20 bp, Artificial Sequence
  Description of Artificial Sequence: Synthetic oligonucleotide
gcactccaacctgggtgaca

SEQ ID NO: 10010 - DNA, 20 bp, Artificial Sequence
  Description of Artificial Sequence: Synthetic oligonucleotide
cactccaacctgggtgacag

SEQ ID NO: 10011 - DNA, 20 bp, Artificial Sequence
  Description of Artificial Sequence: Synthetic oligonucleotide
actccaacctgggtgacaga

SEQ ID NO: 10012 - DNA, 20 bp, Artificial Sequence
  Description of Artificial Sequence: Synthetic oligonucleotide
ctccaacctgggtgacagag

SEQ ID NO: 10013 - DNA, 20 bp, Artificial Sequence
  Description of Artificial Sequence: Synthetic oligonucleotide
tccaacctgggtgacagagt

SEQ ID NO: 10014 - DNA, 20 bp, Artificial Sequence
  Description of Artificial Sequence: Synthetic oligonucleotide
ccaacctgggtgacagagtg

SEQ ID NO: 10015 - DNA, 20 bp, Artificial Sequence
  Description of Artificial Sequence: Synthetic oligonucleotide
caacctgggtgacagagtga

SEQ ID NO: 10016 - DNA, 20 bp, Artificial Sequence
  Description of Artificial Sequence: Synthetic oligonucleotide
aacctgggtgacagagtgag

SEQ ID NO: 10017 - DNA, 20 bp, Artificial Sequence
  Description of Artificial Sequence: Synthetic oligonucleotide
acctgggtgacagagtgaga

SEQ ID NO: 10018 - DNA, 20 bp, Artificial Sequence
  Description of Artificial Sequence: Synthetic oligonucleotide
cctgggtgacagagtgagac

SEQ ID NO: 10019 - DNA, 20 bp, Artificial Sequence
  Description of Artificial Sequence: Synthetic oligonucleotide
ctgggtgacagagtgagact

SEQ ID NO: 10020 - DNA, 20 bp, Artificial Sequence
  Description of Artificial Sequence: Synthetic oligonucleotide
tgggtgacagagtgagactc

SEQ ID NO: 10021 - DNA, 20 bp, Artificial Sequence
  Description of Artificial Sequence: Synthetic oligonucleotide
gggtgacagagtgagactct

SEQ ID NO: 10022 - DNA, 20 bp, Artificial Sequence
  Description of Artificial Sequence: Synthetic oligonucleotide
ggtgacagagtgagactctg

SEQ ID NO: 10023 - DNA, 20 bp, Artificial Sequence
  Description of Artificial Sequence: Synthetic oligonucleotide
gtgacagagtgagactctgt

SEQ ID NO: 10024 - DNA, 20 bp, Artificial Sequence
  Description of Artificial Sequence: Synthetic oligonucleotide
tgacagagtgagactctgtc

SEQ ID NO: 10025 - DNA, 20 bp, Artificial Sequence
  Description of Artificial Sequence: Synthetic oligonucleotide
gacagagtgagactctgtct

SEQ ID NO: 10026 - DNA, 20 bp, Artificial Sequence
  Description of Artificial Sequence: Synthetic oligonucleotide
acagagtgagactctgtctc

SEQ ID NO: 10027 - DNA, 20 bp, Artificial Sequence
  Description of Artificial Sequence: Synthetic oligonucleotide
cagagtgagactctgtctca

SEQ ID NO: 10028 - DNA, 20 bp, Artificial Sequence
  Description of Artificial Sequence: Synthetic oligonucleotide
agagtgagactctgtctcaa

SEQ ID NO: 10029 - DNA, 20 bp, Artificial Sequence
  Description of Artificial Sequence: Synthetic oligonucleotide
gagtgagactctgtctcaaa

SEQ ID NO: 10030 - DNA, 20 bp, Artificial Sequence
  Description of Artificial Sequence: Synthetic oligonucleotide
agtgagactctgtctcaaaa

SEQ ID NO: 10031 - DNA, 20 bp, Artificial Sequence
  Description of Artificial Sequence: Synthetic oligonucleotide
gtgagactctgtctcaaaaa

SEQ ID NO: 10032 - DNA, 20 bp, Artificial Sequence
  Description of Artificial Sequence: Synthetic oligonucleotide
tgagactctgtctcaaaaaa

SEQ ID NO: 10033 - DNA, 20 bp, Artificial Sequence
  Description of Artificial Sequence: Synthetic oligonucleotide
gagactctgtctcaaaaaaa

SEQ ID NO: 10034 - DNA, 20 bp, Artificial Sequence
  Description of Artificial Sequence: Synthetic oligonucleotide
agactctgtctcaaaaaaaa

SEQ ID NO: 10035 - DNA, 20 bp, Artificial Sequence
  Description of Artificial Sequence: Synthetic oligonucleotide
gactctgtctcaaaaaaaaa

SEQ ID NO: 10036 - DNA, 20 bp, Artificial Sequence
  Description of Artificial Sequence: Synthetic oligonucleotide
actctgtctcaaaaaaaaaa

SEQ ID NO: 10037 - DNA, 20 bp, Artificial Sequence
  Description of Artificial Sequence: Synthetic oligonucleotide
ctctgtctcaaaaaaaaaaa

SEQ ID NO: 10038 - DNA, 20 bp, Artificial Sequence
  Description of Artificial Sequence: Synthetic oligonucleotide
tctgtctcaaaaaaaaaaaa

SEQ ID NO: 10039 - DNA, 20 bp, Artificial Sequence
  Description of Artificial Sequence: Synthetic oligonucleotide
ctgtctcaaaaaaaaaaaag

SEQ ID NO: 10040 - DNA, 20 bp, Artificial Sequence
  Description of Artificial Sequence: Synthetic oligonucleotide
tgtctcaaaaaaaaaaaaga

SEQ ID NO: 10041 - DNA, 20 bp, Artificial Sequence
  Description of Artificial Sequence: Synthetic oligonucleotide
gtctcaaaaaaaaaaaagac

SEQ ID NO: 10042 - DNA, 20 bp, Artificial Sequence
  Description of Artificial Sequence: Synthetic oligonucleotide
tctcaaaaaaaaaaaagact

SEQ ID NO: 10043 - DNA, 20 bp, Artificial Sequence
  Description of Artificial Sequence: Synthetic oligonucleotide
ctcaaaaaaaaaaaagactt

SEQ ID NO: 10044 - DNA, 20 bp, Artificial Sequence
  Description of Artificial Sequence: Synthetic oligonucleotide
tcaaaaaaaaaaaagacttg

SEQ ID NO: 10045 - DNA, 20 bp, Artificial Sequence
  Description of Artificial Sequence: Synthetic oligonucleotide
caaaaaaaaaaaagacttga

SEQ ID NO: 10046 - DNA, 20 bp, Artificial Sequence
  Description of Artificial Sequence: Synthetic oligonucleotide
aaaaaaaaaaaagacttgat

SEQ ID NO: 10047 - DNA, 20 bp, Artificial Sequence
  Description of Artificial Sequence: Synthetic oligonucleotide
aaaaaaaaaaagacttgata

SEQ ID NO: 10048 - DNA, 20 bp, Artificial Sequence
  Description of Artificial Sequence: Synthetic oligonucleotide
aaaaaaaaaagacttgataa

SEQ ID NO: 10049 - DNA, 20 bp, Artificial Sequence
  Description of Artificial Sequence: Synthetic oligonucleotide
aaaaaaaaagacttgataaa

SEQ ID NO: 10050 - DNA, 20 bp, Artificial Sequence
  Description of Artificial Sequence: Synthetic oligonucleotide
aaaaaaaagacttgataaat

SEQ ID NO: 10051 - DNA, 20 bp, Artificial Sequence
  Description of Artificial Sequence: Synthetic oligonucleotide
aaaaaaagacttgataaatg

SEQ ID NO: 10052 - DNA, 20 bp, Artificial Sequence
  Description of Artificial Sequence: Synthetic oligonucleotide
aaaaaagacttgataaatga

SEQ ID NO: 10053 - DNA, 20 bp, Artificial Sequence
  Description of Artificial Sequence: Synthetic oligonucleotide
aaaaagacttgataaatgaa

SEQ ID NO: 10054 - DNA, 20 bp, Artificial Sequence
  Description of Artificial Sequence: Synthetic oligonucleotide
aaaagacttgataaatgaat

SEQ ID NO: 10055 - DNA, 20 bp, Artificial Sequence
  Description of Artificial Sequence: Synthetic oligonucleotide
aaagacttgataaatgaata

SEQ ID NO: 10056 - DNA, 20 bp, Artificial Sequence
  Description of Artificial Sequence: Synthetic oligonucleotide
aagacttgataaatgaataa

SEQ ID NO: 10057 - DNA, 20 bp, Artificial Sequence
  Description of Artificial Sequence: Synthetic oligonucleotide
agacttgataaatgaataaa

SEQ ID NO: 10058 - DNA, 20 bp, Artificial Sequence
  Description of Artificial Sequence: Synthetic oligonucleotide
gacttgataaatgaataaaa

SEQ ID NO: 10059 - DNA, 20 bp, Artificial Sequence
  Description of Artificial Sequence: Synthetic oligonucleotide
acttgataaatgaataaaaa

SEQ ID NO: 10060 - DNA, 20 bp, Artificial Sequence
  Description of Artificial Sequence: Synthetic oligonucleotide
cttgataaatgaataaaaat

SEQ ID NO: 10061 - DNA, 20 bp, Artificial Sequence
  Description of Artificial Sequence: Synthetic oligonucleotide
ttgataaatgaataaaaatt

SEQ ID NO: 10062 - DNA, 20 bp, Artificial Sequence
  Description of Artificial Sequence: Synthetic oligonucleotide
tgataaatgaataaaaatta

SEQ ID NO: 10063 - DNA, 20 bp, Artificial Sequence
  Description of Artificial Sequence: Synthetic oligonucleotide
gataaatgaataaaaattag

SEQ ID NO: 10064 - DNA, 20 bp, Artificial Sequence
  Description of Artificial Sequence: Synthetic oligonucleotide
ataaatgaataaaaattagc

SEQ ID NO: 10065 - DNA, 20 bp, Artificial Sequence
  Description of Artificial Sequence: Synthetic oligonucleotide
taaatgaataaaaattagct

SEQ ID NO: 10066 - DNA, 20 bp, Artificial Sequence
  Description of Artificial Sequence: Synthetic oligonucleotide
aaatgaataaaaattagctg

SEQ ID NO: 10067 - DNA, 20 bp, Artificial Sequence
  Description of Artificial Sequence: Synthetic oligonucleotide
aatgaataaaaattagctgg

SEQ ID NO: 10068 - DNA, 20 bp, Artificial Sequence
  Description of Artificial Sequence: Synthetic oligonucleotide
atgaataaaaattagctggg

SEQ ID NO: 10069 - DNA, 20 bp, Artificial Sequence
  Description of Artificial Sequence: Synthetic oligonucleotide
tgaataaaaattagctgggc

SEQ ID NO: 10070 - DNA, 20 bp, Artificial Sequence
  Description of Artificial Sequence: Synthetic oligonucleotide
gaataaaaattagctgggcg

SEQ ID NO: 10071 - DNA, 20 bp, Artificial Sequence
  Description of Artificial Sequence: Synthetic oligonucleotide
aataaaaattagctgggcgt

SEQ ID NO: 10072 - DNA, 20 bp, Artificial Sequence
  Description of Artificial Sequence: Synthetic oligonucleotide
ataaaaattagctgggcgtg

SEQ ID NO: 10073 - DNA, 20 bp, Artificial Sequence
  Description of Artificial Sequence: Synthetic oligonucleotide
taaaaattagctgggcgtgg

SEQ ID NO: 10074 - DNA, 20 bp, Artificial Sequence
  Description of Artificial Sequence: Synthetic oligonucleotide
aaaaattagctgggcgtggt

SEQ ID NO: 10075 - DNA, 20 bp, Artificial Sequence
  Description of Artificial Sequence: Synthetic oligonucleotide
aaaattagctgggcgtggtg

SEQ ID NO: 10076 - DNA, 20 bp, Artificial Sequence
  Description of Artificial Sequence: Synthetic oligonucleotide
aaattagctgggcgtggtgg

SEQ ID NO: 10077 - DNA, 20 bp, Artificial Sequence
  Description of Artificial Sequence: Synthetic oligonucleotide
aattagctgggcgtggtggc

SEQ ID NO: 10078 - DNA, 20 bp, Artificial Sequence
  Description of Artificial Sequence: Synthetic oligonucleotide
attagctgggcgtggtggcg

SEQ ID NO: 10079 - DNA, 20 bp, Artificial Sequence
  Description of Artificial Sequence: Synthetic oligonucleotide
ttagctgggcgtggtggcgg

SEQ ID NO: 10080 - DNA, 20 bp, Artificial Sequence
  Description of Artificial Sequence: Synthetic oligonucleotide
tagctgggcgtggtggcggt

SEQ ID NO: 10081 - DNA, 20 bp, Artificial Sequence
  Description of Artificial Sequence: Synthetic oligonucleotide
agctgggcgtggtggcggta

SEQ ID NO: 10082 - DNA, 20 bp, Artificial Sequence
  Description of Artificial Sequence: Synthetic oligonucleotide
gctgggcgtggtggcggtag

SEQ ID NO: 10083 - DNA, 20 bp, Artificial Sequence
  Description of Artificial Sequence: Synthetic oligonucleotide
ctgggcgtggtggcggtagg

SEQ ID NO: 10084 - DNA, 20 bp, Artificial Sequence
  Description of Artificial Sequence: Synthetic oligonucleotide
tgggcgtggtggcggtaggc

SEQ ID NO: 10085 - DNA, 20 bp, Artificial Sequence
  Description of Artificial Sequence: Synthetic oligonucleotide
gggcgtggtggcggtaggcg

SEQ ID NO: 10086 - DNA, 20 bp, Artificial Sequence
  Description of Artificial Sequence: Synthetic oligonucleotide
ggcgtggtggcggtaggcgc

SEQ ID NO: 10087 - DNA, 20 bp, Artificial Sequence
  Description of Artificial Sequence: Synthetic oligonucleotide
gcgtggtggcggtaggcgcc

SEQ ID NO: 10088 - DNA, 20 bp, Artificial Sequence
  Description of Artificial Sequence: Synthetic oligonucleotide
cgtggtggcggtaggcgcct

SEQ ID NO: 10089 - DNA, 20 bp, Artificial Sequence
  Description of Artificial Sequence: Synthetic oligonucleotide
gtggtggcggtaggcgccta

SEQ ID NO: 10090 - DNA, 20 bp, Artificial Sequence
  Description of Artificial Sequence: Synthetic oligonucleotide
tggtggcggtaggcgcctat

SEQ ID NO: 10091 - DNA, 20 bp, Artificial Sequence
  Description of Artificial Sequence: Synthetic oligonucleotide
ggtggcggtaggcgcctata

SEQ ID NO: 10092 - DNA, 20 bp, Artificial Sequence
  Description of Artificial Sequence: Synthetic oligonucleotide
gtggcggtaggcgcctataa

SEQ ID NO: 10093 - DNA, 20 bp, Artificial Sequence
  Description of Artificial Sequence: Synthetic oligonucleotide
tggcggtaggcgcctataat

SEQ ID NO: 10094 - DNA, 20 bp, Artificial Sequence
  Description of Artificial Sequence: Synthetic oligonucleotide
ggcggtaggcgcctataatc

SEQ ID NO: 10095 - DNA, 20 bp, Artificial Sequence
  Description of Artificial Sequence: Synthetic oligonucleotide
gcggtaggcgcctataatcc

SEQ ID NO: 10096 - DNA, 20 bp, Artificial Sequence
  Description of Artificial Sequence: Synthetic oligonucleotide
cggtaggcgcctataatccc

SEQ ID NO: 10097 - DNA, 20 bp, Artificial Sequence
  Description of Artificial Sequence: Synthetic oligonucleotide
ggtaggcgcctataatccca

SEQ ID NO: 10098 - DNA, 20 bp, Artificial Sequence
  Description of Artificial Sequence: Synthetic oligonucleotide
gtaggcgcctataatcccat

SEQ ID NO: 10099 - DNA, 20 bp, Artificial Sequence
  Description of Artificial Sequence: Synthetic oligonucleotide
taggcgcctataatcccatc

SEQ ID NO: 10100 - DNA, 20 bp, Artificial Sequence
  Description of Artificial Sequence: Synthetic oligonucleotide
aggcgcctataatcccatct

SEQ ID NO: 10101 - DNA, 20 bp, Artificial Sequence
  Description of Artificial Sequence: Synthetic oligonucleotide
ggcgcctataatcccatcta

SEQ ID NO: 10102 - DNA, 20 bp, Artificial Sequence
  Description of Artificial Sequence: Synthetic oligonucleotide
gcgcctataatcccatctac

SEQ ID NO: 10103 - DNA, 20 bp, Artificial Sequence
  Description of Artificial Sequence: Synthetic oligonucleotide
cgcctataatcccatctact

SEQ ID NO: 10104 - DNA, 20 bp, Artificial Sequence
  Description of Artificial Sequence: Synthetic oligonucleotide
gcctataatcccatctactt

SEQ ID NO: 10105 - DNA, 20 bp, Artificial Sequence
  Description of Artificial Sequence: Synthetic oligonucleotide
cctataatcccatctacttg

SEQ ID NO: 10106 - DNA, 20 bp, Artificial Sequence
  Description of Artificial Sequence: Synthetic oligonucleotide
ctataatcccatctacttga

SEQ ID NO: 10107 - DNA, 20 bp, Artificial Sequence
  Description of Artificial Sequence: Synthetic oligonucleotide
tataatcccatctacttgag

SEQ ID NO: 10108 - DNA, 20 bp, Artificial Sequence
  Description of Artificial Sequence: Synthetic oligonucleotide
ataatcccatctacttgaga

SEQ ID NO: 10109 - DNA, 20 bp, Artificial Sequence
  Description of Artificial Sequence: Synthetic oligonucleotide
taatcccatctacttgagag

SEQ ID NO: 10110 - DNA, 20 bp, Artificial Sequence
  Description of Artificial Sequence: Synthetic oligonucleotide
aatcccatctacttgagagg

SEQ ID NO: 10111 - DNA, 20 bp, Artificial Sequence
  Description of Artificial Sequence: Synthetic oligonucleotide
atcccatctacttgagaggc

SEQ ID NO: 10112 - DNA, 20 bp, Artificial Sequence
  Description of Artificial Sequence: Synthetic oligonucleotide
tcccatctacttgagaggct

SEQ ID NO: 10113 - DNA, 20 bp, Artificial Sequence
  Description of Artificial Sequence: Synthetic oligonucleotide
cccatctacttgagaggctg

SEQ ID NO: 10114 - DNA, 20 bp, Artificial Sequence
  Description of Artificial Sequence: Synthetic oligonucleotide
ccatctacttgagaggctga

SEQ ID NO: 10115 - DNA, 20 bp, Artificial Sequence
  Description of Artificial Sequence: Synthetic oligonucleotide
catctacttgagaggctgag

SEQ ID NO: 10116 - DNA, 20 bp, Artificial Sequence
  Description of Artificial Sequence: Synthetic oligonucleotide
atctacttgagaggctgagg

SEQ ID NO: 10117 - DNA, 20 bp, Artificial Sequence
  Description of Artificial Sequence: Synthetic oligonucleotide
tctacttgagaggctgaggc

SEQ ID NO: 10118 - DNA, 20 bp, Artificial Sequence
  Description of Artificial Sequence: Synthetic oligonucleotide
ctacttgagaggctgaggca

SEQ ID NO: 10119 - DNA, 20 bp, Artificial Sequence
  Description of Artificial Sequence: Synthetic oligonucleotide
tacttgagaggctgaggcag

SEQ ID NO: 10120 - DNA, 20 bp, Artificial Sequence
  Description of Artificial Sequence: Synthetic oligonucleotide
acttgagaggctgaggcagg

SEQ ID NO: 10121 - DNA, 20 bp, Artificial Sequence
  Description of Artificial Sequence: Synthetic oligonucleotide
cttgagaggctgaggcagga

SEQ ID NO: 10122 - DNA, 20 bp, Artificial Sequence
  Description of Artificial Sequence: Synthetic oligonucleotide
ttgagaggctgaggcaggag

SEQ ID NO: 10123 - DNA, 20 bp, Artificial Sequence
  Description of Artificial Sequence: Synthetic oligonucleotide
tgagaggctgaggcaggaga

SEQ ID NO: 10124 - DNA, 20 bp, Artificial Sequence
  Description of Artificial Sequence: Synthetic oligonucleotide
gagaggctgaggcaggagaa

SEQ ID NO: 10125 - DNA, 20 bp, Artificial Sequence
  Description of Artificial Sequence: Synthetic oligonucleotide
agaggctgaggcaggagaat

SEQ ID NO: 10126 - DNA, 20 bp, Artificial Sequence
  Description of Artificial Sequence: Synthetic oligonucleotide
gaggctgaggcaggagaatc

SEQ ID NO: 10127 - DNA, 20 bp, Artificial Sequence
  Description of Artificial Sequence: Synthetic oligonucleotide
aggctgaggcaggagaatca

SEQ ID NO: 10128 - DNA, 20 bp, Artificial Sequence
  Description of Artificial Sequence: Synthetic oligonucleotide
ggctgaggcaggagaatcac

SEQ ID NO: 10129 - DNA, 20 bp, Artificial Sequence
  Description of Artificial Sequence: Synthetic oligonucleotide
gctgaggcaggagaatcact

SEQ ID NO: 10130 - DNA, 20 bp, Artificial Sequence
  Description of Artificial Sequence: Synthetic oligonucleotide
ctgaggcaggagaatcactt

SEQ ID NO: 10131 - DNA, 20 bp, Artificial Sequence
  Description of Artificial Sequence: Synthetic oligonucleotide
tgaggcaggagaatcacttg

SEQ ID NO: 10132 - DNA, 20 bp, Artificial Sequence
  Description of Artificial Sequence: Synthetic oligonucleotide
gaggcaggagaatcacttga

SEQ ID NO: 10133 - DNA, 20 bp, Artificial Sequence
  Description of Artificial Sequence: Synthetic oligonucleotide
aggcaggagaatcacttgaa

SEQ ID NO: 10134 - DNA, 20 bp, Artificial Sequence
  Description of Artificial Sequence: Synthetic oligonucleotide
ggcaggagaatcacttgaac

SEQ ID NO: 10135 - DNA, 20 bp, Artificial Sequence
  Description of Artificial Sequence: Synthetic oligonucleotide
gcaggagaatcacttgaacc

SEQ ID NO: 10136 - DNA, 20 bp, Artificial Sequence
  Description of Artificial Sequence: Synthetic oligonucleotide
caggagaatcacttgaaccc

SEQ ID NO: 10137 - DNA, 20 bp, Artificial Sequence
  Description of Artificial Sequence: Synthetic oligonucleotide
aggagaatcacttgaaccca

SEQ ID NO: 10138 - DNA, 20 bp, Artificial Sequence
  Description of Artificial Sequence: Synthetic oligonucleotide
ggagaatcacttgaacccag

SEQ ID NO: 10139 - DNA, 20 bp, Artificial Sequence
  Description of Artificial Sequence: Synthetic oligonucleotide
gagaatcacttgaacccagt

SEQ ID NO: 10140 - DNA, 20 bp, Artificial Sequence
  Description of Artificial Sequence: Synthetic oligonucleotide
agaatcacttgaacccagtg

SEQ ID NO: 10141 - DNA, 20 bp, Artificial Sequence
  Description of Artificial Sequence: Synthetic oligonucleotide
gaatcacttgaacccagtgg

SEQ ID NO: 10142 - DNA, 20 bp, Artificial Sequence
  Description of Artificial Sequence: Synthetic oligonucleotide
aatcacttgaacccagtggg

SEQ ID NO: 10143 - DNA, 20 bp, Artificial Sequence
  Description of Artificial Sequence: Synthetic oligonucleotide
atcacttgaacccagtggga

SEQ ID NO: 10144 - DNA, 20 bp, Artificial Sequence
  Description of Artificial Sequence: Synthetic oligonucleotide
tcacttgaacccagtgggag

SEQ ID NO: 10145 - DNA, 20 bp, Artificial Sequence
  Description of Artificial Sequence: Synthetic oligonucleotide
cacttgaacccagtgggagg

SEQ ID NO: 10146 - DNA, 20 bp, Artificial Sequence
  Description of Artificial Sequence: Synthetic oligonucleotide
acttgaacccagtgggaggc

SEQ ID NO: 10147 - DNA, 20 bp, Artificial Sequence
  Description of Artificial Sequence: Synthetic oligonucleotide
cttgaacccagtgggaggca

SEQ ID NO: 10148 - DNA, 20 bp, Artificial Sequence
  Description of Artificial Sequence: Synthetic oligonucleotide
ttgaacccagtgggaggcag

SEQ ID NO: 10149 - DNA, 20 bp, Artificial Sequence
  Description of Artificial Sequence: Synthetic oligonucleotide
tgaacccagtgggaggcaga

SEQ ID NO: 10150 - DNA, 20 bp, Artificial Sequence
  Description of Artificial Sequence: Synthetic oligonucleotide
gaacccagtgggaggcagag

SEQ ID NO: 10151 - DNA, 20 bp, Artificial Sequence
  Description of Artificial Sequence: Synthetic oligonucleotide
aacccagtgggaggcagagg

SEQ ID NO: 10152 - DNA, 20 bp, Artificial Sequence
  Description of Artificial Sequence: Synthetic oligonucleotide
acccagtgggaggcagaggt

SEQ ID NO: 10153 - DNA, 20 bp, Artificial Sequence
  Description of Artificial Sequence: Synthetic oligonucleotide
cccagtgggaggcagaggtt

SEQ ID NO: 10154 - DNA, 20 bp, Artificial Sequence
  Description of Artificial Sequence: Synthetic oligonucleotide
ccagtgggaggcagaggttg

SEQ ID NO: 10155 - DNA, 20 bp, Artificial Sequence
  Description of Artificial Sequence: Synthetic oligonucleotide
cagtgggaggcagaggttgc

SEQ ID NO: 10156 - DNA, 20 bp, Artificial Sequence
  Description of Artificial Sequence: Synthetic oligonucleotide
agtgggaggcagaggttgca

SEQ ID NO: 10157 - DNA, 20 bp, Artificial Sequence
  Description of Artificial Sequence: Synthetic oligonucleotide
gtgggaggcagaggttgcag

SEQ ID NO: 10158 - DNA, 20 bp, Artificial Sequence
  Description of Artificial Sequence: Synthetic oligonucleotide
tgggaggcagaggttgcagt

SEQ ID NO: 10159 - DNA, 20 bp, Artificial Sequence
  Description of Artificial Sequence: Synthetic oligonucleotide
gggaggcagaggttgcagtg

SEQ ID NO: 10160 - DNA, 20 bp, Artificial Sequence
  Description of Artificial Sequence: Synthetic oligonucleotide
ggaggcagaggttgcagtga

SEQ ID NO: 10161 - DNA, 20 bp, Artificial Sequence
  Description of Artificial Sequence: Synthetic oligonucleotide
gaggcagaggttgcagtgag

SEQ ID NO: 10162 - DNA, 20 bp, Artificial Sequence
  Description of Artificial Sequence: Synthetic oligonucleotide
aggcagaggttgcagtgagc

SEQ ID NO: 10163 - DNA, 20 bp, Artificial Sequence
  Description of Artificial Sequence: Synthetic oligonucleotide
ggcagaggttgcagtgagct

SEQ ID NO: 10164 - DNA, 20 bp, Artificial Sequence
  Description of Artificial Sequence: Synthetic oligonucleotide
gcagaggttgcagtgagctg

SEQ ID NO: 10165 - DNA, 20 bp, Artificial Sequence
  Description of Artificial Sequence: Synthetic oligonucleotide
cagaggttgcagtgagctga

SEQ ID NO: 10166 - DNA, 20 bp, Artificial Sequence
  Description of Artificial Sequence: Synthetic oligonucleotide
agaggttgcagtgagctgag

SEQ ID NO: 10167 - DNA, 20 bp, Artificial Sequence
  Description of Artificial Sequence: Synthetic oligonucleotide
gaggttgcagtgagctgaga

SEQ ID NO: 10168 - DNA, 20 bp, Artificial Sequence
  Description of Artificial Sequence: Synthetic oligonucleotide
aggttgcagtgagctgagat

SEQ ID NO: 10169 - DNA, 20 bp, Artificial Sequence
  Description of Artificial Sequence: Synthetic oligonucleotide
ggttgcagtgagctgagatt

SEQ ID NO: 10170 - DNA, 20 bp, Artificial Sequence
  Description of Artificial Sequence: Synthetic oligonucleotide
gttgcagtgagctgagattg

SEQ ID NO: 10171 - DNA, 20 bp, Artificial Sequence
  Description of Artificial Sequence: Synthetic oligonucleotide
ttgcagtgagctgagattgc

SEQ ID NO: 10172 - DNA, 20 bp, Artificial Sequence
  Description of Artificial Sequence: Synthetic oligonucleotide
tgcagtgagctgagattgcg

SEQ ID NO: 10173 - DNA, 20 bp, Artificial Sequence
  Description of Artificial Sequence: Synthetic oligonucleotide
gcagtgagctgagattgcgc

SEQ ID NO: 10174 - DNA, 20 bp, Artificial Sequence
  Description of Artificial Sequence: Synthetic oligonucleotide
cagtgagctgagattgcgcc

SEQ ID NO: 10175 - DNA, 20 bp, Artificial Sequence
  Description of Artificial Sequence: Synthetic oligonucleotide
agtgagctgagattgcgcca

SEQ ID NO: 10176 - DNA, 20 bp, Artificial Sequence
  Description of Artificial Sequence: Synthetic oligonucleotide
gtgagctgagattgcgccac

SEQ ID NO: 10177 - DNA, 20 bp, Artificial Sequence
  Description of Artificial Sequence: Synthetic oligonucleotide
tgagctgagattgcgccact

SEQ ID NO: 10178 - DNA, 20 bp, Artificial Sequence
  Description of Artificial Sequence: Synthetic oligonucleotide
gagctgagattgcgccactg

SEQ ID NO: 10179 - DNA, 20 bp, Artificial Sequence
  Description of Artificial Sequence: Synthetic oligonucleotide
agctgagattgcgccactgc

SEQ ID NO: 10180 - DNA, 20 bp, Artificial Sequence
  Description of Artificial Sequence: Synthetic oligonucleotide
gctgagattgcgccactgca

SEQ ID NO: 10181 - DNA, 20 bp, Artificial Sequence
  Description of Artificial Sequence: Synthetic oligonucleotide
ctgagattgcgccactgcac

SEQ ID NO: 10182 - DNA, 20 bp, Artificial Sequence
  Description of Artificial Sequence: Synthetic oligonucleotide
tgagattgcgccactgcact

SEQ ID NO: 10183 - DNA, 20 bp, Artificial Sequence
  Description of Artificial Sequence: Synthetic oligonucleotide
gagattgcgccactgcactc

SEQ ID NO: 10184 - DNA, 20 bp, Artificial Sequence
  Description of Artificial Sequence: Synthetic oligonucleotide
agattgcgccactgcactcc

SEQ ID NO: 10185 - DNA, 20 bp, Artificial Sequence
  Description of Artificial Sequence: Synthetic oligonucleotide
gattgcgccactgcactcca

SEQ ID NO: 10186 - DNA, 20 bp, Artificial Sequence
  Description of Artificial Sequence: Synthetic oligonucleotide
attgcgccactgcactccag

SEQ ID NO: 10187 - DNA, 20 bp, Artificial Sequence
  Description of Artificial Sequence: Synthetic oligonucleotide
ttgcgccactgcactccagc

SEQ ID NO: 10188 - DNA, 20 bp, Artificial Sequence
  Description of Artificial Sequence: Synthetic oligonucleotide
tgcgccactgcactccagcc

SEQ ID NO: 10189 - DNA, 20 bp, Artificial Sequence
  Description of Artificial Sequence: Synthetic oligonucleotide
gcgccactgcactccagcct

SEQ ID NO: 10190 - DNA, 20 bp, Artificial Sequence
  Description of Artificial Sequence: Synthetic oligonucleotide
cgccactgcactccagcctg

SEQ ID NO: 10191 - DNA, 20 bp, Artificial Sequence
  Description of Artificial Sequence: Synthetic oligonucleotide
gccactgcactccagcctgg

SEQ ID NO: 10192 - DNA, 20 bp, Artificial Sequence
  Description of Artificial Sequence: Synthetic oligonucleotide
ccactgcactccagcctgga

SEQ ID NO: 10193 - DNA, 20 bp, Artificial Sequence
  Description of Artificial Sequence: Synthetic oligonucleotide
cactgcactccagcctggac

SEQ ID NO: 10194 - DNA, 20 bp, Artificial Sequence
  Description of Artificial Sequence: Synthetic oligonucleotide
actgcactccagcctggaca

SEQ ID NO: 10195 - DNA, 20 bp, Artificial Sequence
  Description of Artificial Sequence: Synthetic oligonucleotide
ctgcactccagcctggacaa

SEQ ID NO: 10196 - DNA, 20 bp, Artificial Sequence
  Description of Artificial Sequence: Synthetic oligonucleotide
tgcactccagcctggacaac

SEQ ID NO: 10197 - DNA, 20 bp, Artificial Sequence
  Description of Artificial Sequence: Synthetic oligonucleotide
gcactccagcctggacaaca

SEQ ID NO: 10198 - DNA, 20 bp, Artificial Sequence
  Description of Artificial Sequence: Synthetic oligonucleotide
cactccagcctggacaacag

SEQ ID NO: 10199 - DNA, 20 bp, Artificial Sequence
  Description of Artificial Sequence: Synthetic oligonucleotide
actccagcctggacaacaga

SEQ ID NO: 10200 - DNA, 20 bp, Artificial Sequence
  Description of Artificial Sequence: Synthetic oligonucleotide
ctccagcctggacaacagag

SEQ ID NO: 10201 - DNA, 20 bp, Artificial Sequence
  Description of Artificial Sequence: Synthetic oligonucleotide
tccagcctggacaacagagc

SEQ ID NO: 10202 - DNA, 20 bp, Artificial Sequence
  Description of Artificial Sequence: Synthetic oligonucleotide
ccagcctggacaacagagcg

SEQ ID NO: 10203 - DNA, 20 bp, Artificial Sequence
  Description of Artificial Sequence: Synthetic oligonucleotide
cagcctggacaacagagcga

SEQ ID NO: 10204 - DNA, 20 bp, Artificial Sequence
  Description of Artificial Sequence: Synthetic oligonucleotide
agcctggacaacagagcgag

SEQ ID NO: 10205 - DNA, 20 bp, Artificial Sequence
  Description of Artificial Sequence: Synthetic oligonucleotide
gcctggacaacagagcgaga

SEQ ID NO: 10206 - DNA, 20 bp, Artificial Sequence
  Description of Artificial Sequence: Synthetic oligonucleotide
cctggacaacagagcgagac

SEQ ID NO: 10207 - DNA, 20 bp, Artificial Sequence
  Description of Artificial Sequence: Synthetic oligonucleotide
ctggacaacagagcgagact

SEQ ID NO: 10208 - DNA, 20 bp, Artificial Sequence
  Description of Artificial Sequence: Synthetic oligonucleotide
tggacaacagagcgagactc

SEQ ID NO: 10209 - DNA, 20 bp, Artificial Sequence
  Description of Artificial Sequence: Synthetic oligonucleotide
ggacaacagagcgagactcc

SEQ ID NO: 10210 - DNA, 20 bp, Artificial Sequence
  Description of Artificial Sequence: Synthetic oligonucleotide
gacaacagagcgagactccg

SEQ ID NO: 10211 - DNA, 20 bp, Artificial Sequence
  Description of Artificial Sequence: Synthetic oligonucleotide
acaacagagcgagactccgt

SEQ ID NO: 10212 - DNA, 20 bp, Artificial Sequence
  Description of Artificial Sequence: Synthetic oligonucleotide
caacagagcgagactccgtc

SEQ ID NO: 10213 - DNA, 20 bp, Artificial Sequence
  Description of Artificial Sequence: Synthetic oligonucleotide
aacagagcgagactccgtct

SEQ ID NO: 10214 - DNA, 20 bp, Artificial Sequence
  Description of Artificial Sequence: Synthetic oligonucleotide
acagagcgagactccgtctc

SEQ ID NO: 10215 - DNA, 20 bp, Artificial Sequence
  Description of Artificial Sequence: Synthetic oligonucleotide
cagagcgagactccgtctca

SEQ ID NO: 10216 - DNA, 20 bp, Artificial Sequence
  Description of Artificial Sequence: Synthetic oligonucleotide
agagcgagactccgtctcaa

SEQ ID NO: 10217 - DNA, 20 bp, Artificial Sequence
  Description of Artificial Sequence: Synthetic oligonucleotide
gagcgagactccgtctcaaa

SEQ ID NO: 10218 - DNA, 20 bp, Artificial Sequence
  Description of Artificial Sequence: Synthetic oligonucleotide
agcgagactccgtctcaaaa

SEQ ID NO: 10219 - DNA, 20 bp, Artificial Sequence
  Description of Artificial Sequence: Synthetic oligonucleotide
gcgagactccgtctcaaaaa

SEQ ID NO: 10220 - DNA, 20 bp, Artificial Sequence
  Description of Artificial Sequence: Synthetic oligonucleotide
cgagactccgtctcaaaaag

SEQ ID NO: 10221 - DNA, 20 bp, Artificial Sequence
  Description of Artificial Sequence: Synthetic oligonucleotide
gagactccgtctcaaaaagc

SEQ ID NO: 10222 - DNA, 20 bp, Artificial Sequence
  Description of Artificial Sequence: Synthetic oligonucleotide
agactccgtctcaaaaagca

SEQ ID NO: 10223 - DNA, 20 bp, Artificial Sequence
  Description of Artificial Sequence: Synthetic oligonucleotide
gactccgtctcaaaaagcaa

SEQ ID NO: 10224 - DNA, 20 bp, Artificial Sequence
  Description of Artificial Sequence: Synthetic oligonucleotide
actccgtctcaaaaagcaaa

SEQ ID NO: 10225 - DNA, 20 bp, Artificial Sequence
  Description of Artificial Sequence: Synthetic oligonucleotide
ctccgtctcaaaaagcaaac

SEQ ID NO: 10226 - DNA, 20 bp, Artificial Sequence
  Description of Artificial Sequence: Synthetic oligonucleotide
tccgtctcaaaaagcaaaca

SEQ ID NO: 10227 - DNA, 20 bp, Artificial Sequence
  Description of Artificial Sequence: Synthetic oligonucleotide
ccgtctcaaaaagcaaacaa

SEQ ID NO: 10228 - DNA, 20 bp, Artificial Sequence
  Description of Artificial Sequence: Synthetic oligonucleotide
cgtctcaaaaagcaaacaaa

SEQ ID NO: 10229 - DNA, 20 bp, Artificial Sequence
  Description of Artificial Sequence: Synthetic oligonucleotide
gtctcaaaaagcaaacaaaa

SEQ ID NO: 10230 - DNA, 20 bp, Artificial Sequence
  Description of Artificial Sequence: Synthetic oligonucleotide
tctcaaaaagcaaacaaaac

SEQ ID NO: 10231 - DNA, 20 bp, Artificial Sequence
  Description of Artificial Sequence: Synthetic oligonucleotide
ctcaaaaagcaaacaaaaca

SEQ ID NO: 10232 - DNA, 20 bp, Artificial Sequence
  Description of Artificial Sequence: Synthetic oligonucleotide
tcaaaaagcaaacaaaacag

SEQ ID NO: 10233 - DNA, 20 bp, Artificial Sequence
  Description of Artificial Sequence: Synthetic oligonucleotide
caaaaagcaaacaaaacagt

SEQ ID NO: 10234 - DNA, 20 bp, Artificial Sequence
  Description of Artificial Sequence: Synthetic oligonucleotide
aaaaagcaaacaaaacagtc

SEQ ID NO: 10235 - DNA, 20 bp, Artificial Sequence
  Description of Artificial Sequence: Synthetic oligonucleotide
aaaagcaaacaaaacagtct

SEQ ID NO: 10236 - DNA, 20 bp, Artificial Sequence
  Description of Artificial Sequence: Synthetic oligonucleotide
aaagcaaacaaaacagtctt

SEQ ID NO: 10237 - DNA, 20 bp, Artificial Sequence
  Description of Artificial Sequence: Synthetic oligonucleotide
aagcaaacaaaacagtcttg

SEQ ID NO: 10238 - DNA, 20 bp, Artificial Sequence
  Description of Artificial Sequence: Synthetic oligonucleotide
agcaaacaaaacagtcttga

SEQ ID NO: 10239 - DNA, 20 bp, Artificial Sequence
  Description of Artificial Sequence: Synthetic oligonucleotide
gcaaacaaaacagtcttgac

SEQ ID NO: 10240 - DNA, 20 bp, Artificial Sequence
  Description of Artificial Sequence: Synthetic oligonucleotide
caaacaaaacagtcttgaca

SEQ ID NO: 10241 - DNA, 20 bp, Artificial Sequence
  Description of Artificial Sequence: Synthetic oligonucleotide
aaacaaaacagtcttgacaa

SEQ ID NO: 10242 - DNA, 20 bp, Artificial Sequence
  Description of Artificial Sequence: Synthetic oligonucleotide
aacaaaacagtcttgacaaa

SEQ ID NO: 10243 - DNA, 20 bp, Artificial Sequence
  Description of Artificial Sequence: Synthetic oligonucleotide
acaaaacagtcttgacaaat

SEQ ID NO: 10244 - DNA, 20 bp, Artificial Sequence
  Description of Artificial Sequence: Synthetic oligonucleotide
caaaacagtcttgacaaatg

SEQ ID NO: 10245 - DNA, 20 bp, Artificial Sequence
  Description of Artificial Sequence: Synthetic oligonucleotide
aaaacagtcttgacaaatga

SEQ ID NO: 10246 - DNA, 20 bp, Artificial Sequence
  Description of Artificial Sequence: Synthetic oligonucleotide
aaacagtcttgacaaatgaa

SEQ ID NO: 10247 - DNA, 20 bp, Artificial Sequence
  Description of Artificial Sequence: Synthetic oligonucleotide
aacagtcttgacaaatgaat

SEQ ID NO: 10248 - DNA, 20 bp, Artificial Sequence
  Description of Artificial Sequence: Synthetic oligonucleotide
acagtcttgacaaatgaatg

SEQ ID NO: 10249 - DNA, 20 bp, Artificial Sequence
  Description of Artificial Sequence: Synthetic oligonucleotide
cagtcttgacaaatgaatga

SEQ ID NO: 10250 - DNA, 20 bp, Artificial Sequence
  Description of Artificial Sequence: Synthetic oligonucleotide
agtcttgacaaatgaatgaa

SEQ ID NO: 10251 - DNA, 20 bp, Artificial Sequence
  Description of Artificial Sequence: Synthetic oligonucleotide
gtcttgacaaatgaatgaat

SEQ ID NO: 10252 - DNA, 20 bp, Artificial Sequence
  Description of Artificial Sequence: Synthetic oligonucleotide
tcttgacaaatgaatgaatg

SEQ ID NO: 10253 - DNA, 20 bp, Artificial Sequence
  Description of Artificial Sequence: Synthetic oligonucleotide
cttgacaaatgaatgaatga

SEQ ID NO: 10254 - DNA, 20 bp, Artificial Sequence
  Description of Artificial Sequence: Synthetic oligonucleotide
ttgacaaatgaatgaatgaa

SEQ ID NO: 10255 - DNA, 20 bp, Artificial Sequence
  Description of Artificial Sequence: Synthetic oligonucleotide
tgacaaatgaatgaatgaat

SEQ ID NO: 10256 - DNA, 20 bp, Artificial Sequence
  Description of Artificial Sequence: Synthetic oligonucleotide
gacaaatgaatgaatgaatg

SEQ ID NO: 10257 - DNA, 20 bp, Artificial Sequence
  Description of Artificial Sequence: Synthetic oligonucleotide
acaaatgaatgaatgaatga

SEQ ID NO: 10258 - DNA, 20 bp, Artificial Sequence
  Description of Artificial Sequence: Synthetic oligonucleotide
caaatgaatgaatgaatgaa

SEQ ID NO: 10259 - DNA, 20 bp, Artificial Sequence
  Description of Artificial Sequence: Synthetic oligonucleotide
aaatgaatgaatgaatgaat

SEQ ID NO: 10260 - DNA, 20 bp, Artificial Sequence
  Description of Artificial Sequence: Synthetic oligonucleotide
aatgaatgaatgaatgaatg

SEQ ID NO: 10261 - DNA, 20 bp, Artificial Sequence
  Description of Artificial Sequence: Synthetic oligonucleotide
atgaatgaatgaatgaatga

SEQ ID NO: 10262 - DNA, 20 bp, Artificial Sequence
  Description of Artificial Sequence: Synthetic oligonucleotide
tgaatgaatgaatgaatgaa

SEQ ID NO: 10263 - DNA, 20 bp, Artificial Sequence
  Description of Artificial Sequence: Synthetic oligonucleotide
gaatgaatgaatgaatgaat

SEQ ID NO: 10264 - DNA, 20 bp, Artificial Sequence
  Description of Artificial Sequence: Synthetic oligonucleotide
aatgaatgaatgaatgaatg

SEQ ID NO: 10265 - DNA, 20 bp, Artificial Sequence
  Description of Artificial Sequence: Synthetic oligonucleotide
atgaatgaatgaatgaatga

SEQ ID NO: 10266 - DNA, 20 bp, Artificial Sequence
  Description of Artificial Sequence: Synthetic oligonucleotide
tgaatgaatgaatgaatgag

SEQ ID NO: 10267 - DNA, 20 bp, Artificial Sequence
  Description of Artificial Sequence: Synthetic oligonucleotide
gaatgaatgaatgaatgagg

SEQ ID NO: 10268 - DNA, 20 bp, Artificial Sequence
  Description of Artificial Sequence: Synthetic oligonucleotide
aatgaatgaatgaatgaggc

SEQ ID NO: 10269 - DNA, 20 bp, Artificial Sequence
  Description of Artificial Sequence: Synthetic oligonucleotide
atgaatgaatgaatgaggca

SEQ ID NO: 10270 - DNA, 20 bp, Artificial Sequence
  Description of Artificial Sequence: Synthetic oligonucleotide
tgaatgaatgaatgaggcag

SEQ ID NO: 10271 - DNA, 20 bp, Artificial Sequence
  Description of Artificial Sequence: Synthetic oligonucleotide
gaatgaatgaatgaggcagc

SEQ ID NO: 10272 - DNA, 20 bp, Artificial Sequence
  Description of Artificial Sequence: Synthetic oligonucleotide
aatgaatgaatgaggcagca

SEQ ID NO: 10273 - DNA, 20 bp, Artificial Sequence
  Description of Artificial Sequence: Synthetic oligonucleotide
atgaatgaatgaggcagcag

SEQ ID NO: 10274 - DNA, 20 bp, Artificial Sequence
  Description of Artificial Sequence: Synthetic oligonucleotide
tgaatgaatgaggcagcagg

SEQ ID NO: 10275 - DNA, 20 bp, Artificial Sequence
  Description of Artificial Sequence: Synthetic oligonucleotide
gaatgaatgaggcagcaggt

SEQ ID NO: 10276 - DNA, 20 bp, Artificial Sequence
  Description of Artificial Sequence: Synthetic oligonucleotide
aatgaatgaggcagcaggtc

SEQ ID NO: 10277 - DNA, 20 bp, Artificial Sequence
  Description of Artificial Sequence: Synthetic oligonucleotide
atgaatgaggcagcaggtcc

SEQ ID NO: 10278 - DNA, 20 bp, Artificial Sequence
  Description of Artificial Sequence: Synthetic oligonucleotide
tgaatgaggcagcaggtcca

SEQ ID NO: 10279 - DNA, 20 bp, Artificial Sequence
  Description of Artificial Sequence: Synthetic oligonucleotide
gaatgaggcagcaggtccag

SEQ ID NO: 10280 - DNA, 20 bp, Artificial Sequence
  Description of Artificial Sequence: Synthetic oligonucleotide
aatgaggcagcaggtccaga

SEQ ID NO: 10281 - DNA, 20 bp, Artificial Sequence
  Description of Artificial Sequence: Synthetic oligonucleotide
atgaggcagcaggtccagaa

SEQ ID NO: 10282 - DNA, 20 bp, Artificial Sequence
  Description of Artificial Sequence: Synthetic oligonucleotide
tgaggcagcaggtccagaac

SEQ ID NO: 10283 - DNA, 20 bp, Artificial Sequence
  Description of Artificial Sequence: Synthetic oligonucleotide
gaggcagcaggtccagaacg

SEQ ID NO: 10284 - DNA, 20 bp, Artificial Sequence
  Description of Artificial Sequence: Synthetic oligonucleotide
aggcagcaggtccagaacgg

SEQ ID NO: 10285 - DNA, 20 bp, Artificial Sequence
  Description of Artificial Sequence: Synthetic oligonucleotide
ggcagcaggtccagaacggg

SEQ ID NO: 10286 - DNA, 20 bp, Artificial Sequence
  Description of Artificial Sequence: Synthetic oligonucleotide
gcagcaggtccagaacggga

SEQ ID NO: 10287 - DNA, 20 bp, Artificial Sequence
  Description of Artificial Sequence: Synthetic oligonucleotide
cagcaggtccagaacgggaa

SEQ ID NO: 10288 - DNA, 20 bp, Artificial Sequence
  Description of Artificial Sequence: Synthetic oligonucleotide
agcaggtccagaacgggaag

SEQ ID NO: 10289 - DNA, 20 bp, Artificial Sequence
  Description of Artificial Sequence: Synthetic oligonucleotide
gcaggtccagaacgggaaga

SEQ ID NO: 10290 - DNA, 20 bp, Artificial Sequence
  Description of Artificial Sequence: Synthetic oligonucleotide
caggtccagaacgggaagaa

SEQ ID NO: 10291 - DNA, 20 bp, Artificial Sequence
  Description of Artificial Sequence: Synthetic oligonucleotide
aggtccagaacgggaagaac

SEQ ID NO: 10292 - DNA, 20 bp, Artificial Sequence
  Description of Artificial Sequence: Synthetic oligonucleotide
ggtccagaacgggaagaact

SEQ ID NO: 10293 - DNA, 20 bp, Artificial Sequence
  Description of Artificial Sequence: Synthetic oligonucleotide
gtccagaacgggaagaactg

SEQ ID NO: 10294 - DNA, 20 bp, Artificial Sequence
  Description of Artificial Sequence: Synthetic oligonucleotide
tccagaacgggaagaactgt

SEQ ID NO: 10295 - DNA, 20 bp, Artificial Sequence
  Description of Artificial Sequence: Synthetic oligonucleotide
ccagaacgggaagaactgtg

SEQ ID NO: 10296 - DNA, 20 bp, Artificial Sequence
  Description of Artificial Sequence: Synthetic oligonucleotide
cagaacgggaagaactgtgc

SEQ ID NO: 10297 - DNA, 20 bp, Artificial Sequence
  Description of Artificial Sequence: Synthetic oligonucleotide
agaacgggaagaactgtgct

SEQ ID NO: 10298 - DNA, 20 bp, Artificial Sequence
  Description of Artificial Sequence: Synthetic oligonucleotide
gaacgggaagaactgtgctg

SEQ ID NO: 10299 - DNA, 20 bp, Artificial Sequence
  Description of Artificial Sequence: Synthetic oligonucleotide
aacgggaagaactgtgctga

SEQ ID NO: 10300 - DNA, 20 bp, Artificial Sequence
  Description of Artificial Sequence: Synthetic oligonucleotide
acgggaagaactgtgctgag

SEQ ID NO: 10301 - DNA, 20 bp, Artificial Sequence
  Description of Artificial Sequence: Synthetic oligonucleotide
cgggaagaactgtgctgagc

SEQ ID NO: 10302 - DNA, 20 bp, Artificial Sequence
  Description of Artificial Sequence: Synthetic oligonucleotide
gggaagaactgtgctgagca

SEQ ID NO: 10303 - DNA, 20 bp, Artificial Sequence
  Description of Artificial Sequence: Synthetic oligonucleotide
ggaagaactgtgctgagcag

SEQ ID NO: 10304 - DNA, 20 bp, Artificial Sequence
  Description of Artificial Sequence: Synthetic oligonucleotide
gaagaactgtgctgagcagg

SEQ ID NO: 10305 - DNA, 20 bp, Artificial Sequence
  Description of Artificial Sequence: Synthetic oligonucleotide
aagaactgtgctgagcagga

SEQ ID NO: 10306 - DNA, 20 bp, Artificial Sequence
  Description of Artificial Sequence: Synthetic oligonucleotide
agaactgtgctgagcaggag

SEQ ID NO: 10307 - DNA, 20 bp, Artificial Sequence
  Description of Artificial Sequence: Synthetic oligonucleotide
gaactgtgctgagcaggagc

SEQ ID NO: 10308 - DNA, 20 bp, Artificial Sequence
  Description of Artificial Sequence: Synthetic oligonucleotide
aactgtgctgagcaggagca

SEQ ID NO: 10309 - DNA, 20 bp, Artificial Sequence
  Description of Artificial Sequence: Synthetic oligonucleotide
actgtgctgagcaggagcat

SEQ ID NO: 10310 - DNA, 20 bp, Artificial Sequence
  Description of Artificial Sequence: Synthetic oligonucleotide
ctgtgctgagcaggagcatc

SEQ ID NO: 10311 - DNA, 20 bp, Artificial Sequence
  Description of Artificial Sequence: Synthetic oligonucleotide
tgtgctgagcaggagcatct

SEQ ID NO: 10312 - DNA, 20 bp, Artificial Sequence
  Description of Artificial Sequence: Synthetic oligonucleotide
gtgctgagcaggagcatctc

SEQ ID NO: 10313 - DNA, 20 bp, Artificial Sequence
  Description of Artificial Sequence: Synthetic oligonucleotide
tgctgagcaggagcatctca

SEQ ID NO: 10314 - DNA, 20 bp, Artificial Sequence
  Description of Artificial Sequence: Synthetic oligonucleotide
gctgagcaggagcatctcag

SEQ ID NO: 10315 - DNA, 20 bp, Artificial Sequence
  Description of Artificial Sequence: Synthetic oligonucleotide
ctgagcaggagcatctcaga

SEQ ID NO: 10316 - DNA, 20 bp, Artificial Sequence
  Description of Artificial Sequence: Synthetic oligonucleotide
tgagcaggagcatctcagag

SEQ ID NO: 10317 - DNA, 20 bp, Artificial Sequence
  Description of Artificial Sequence: Synthetic oligonucleotide
gagcaggagcatctcagagg

SEQ ID NO: 10318 - DNA, 20 bp, Artificial Sequence
  Description of Artificial Sequence: Synthetic oligonucleotide
agcaggagcatctcagaggc

SEQ ID NO: 10319 - DNA, 20 bp, Artificial Sequence
  Description of Artificial Sequence: Synthetic oligonucleotide
gcaggagcatctcagaggct

SEQ ID NO: 10320 - DNA, 20 bp, Artificial Sequence
  Description of Artificial Sequence: Synthetic oligonucleotide
caggagcatctcagaggctc

SEQ ID NO: 10321 - DNA, 20 bp, Artificial Sequence
  Description of Artificial Sequence: Synthetic oligonucleotide
aggagcatctcagaggctct

SEQ ID NO: 10322 - DNA, 20 bp, Artificial Sequence
  Description of Artificial Sequence: Synthetic oligonucleotide
ggagcatctcagaggctctg

SEQ ID NO: 10323 - DNA, 20 bp, Artificial Sequence
  Description of Artificial Sequence: Synthetic oligonucleotide
gagcatctcagaggctctgc

SEQ ID NO: 10324 - DNA, 20 bp, Artificial Sequence
  Description of Artificial Sequence: Synthetic oligonucleotide
agcatctcagaggctctgcc

SEQ ID NO: 10325 - DNA, 20 bp, Artificial Sequence
  Description of Artificial Sequence: Synthetic oligonucleotide
gcatctcagaggctctgcct

SEQ ID NO: 10326 - DNA, 20 bp, Artificial Sequence
  Description of Artificial Sequence: Synthetic oligonucleotide
catctcagaggctctgcctg

SEQ ID NO: 10327 - DNA, 20 bp, Artificial Sequence
  Description of Artificial Sequence: Synthetic oligonucleotide
atctcagaggctctgcctgg

SEQ ID NO: 10328 - DNA, 20 bp, Artificial Sequence
  Description of Artificial Sequence: Synthetic oligonucleotide
tctcagaggctctgcctggg

SEQ ID NO: 10329 - DNA, 20 bp, Artificial Sequence
  Description of Artificial Sequence: Synthetic oligonucleotide
ctcagaggctctgcctgggg

SEQ ID NO: 10330 - DNA, 20 bp, Artificial Sequence
  Description of Artificial Sequence: Synthetic oligonucleotide
tcagaggctctgcctggggt

SEQ ID NO: 10331 - DNA, 20 bp, Artificial Sequence
  Description of Artificial Sequence: Synthetic oligonucleotide
cagaggctctgcctggggtc

SEQ ID NO: 10332 - DNA, 20 bp, Artificial Sequence
  Description of Artificial Sequence: Synthetic oligonucleotide
agaggctctgcctggggtcc

SEQ ID NO: 10333 - DNA, 20 bp, Artificial Sequence
  Description of Artificial Sequence: Synthetic oligonucleotide
gaggctctgcctggggtccc

SEQ ID NO: 10334 - DNA, 20 bp, Artificial Sequence
  Description of Artificial Sequence: Synthetic oligonucleotide
aggctctgcctggggtccca

SEQ ID NO: 10335 - DNA, 20 bp, Artificial Sequence
  Description of Artificial Sequence: Synthetic oligonucleotide
ggctctgcctggggtcccag

SEQ ID NO: 10336 - DNA, 20 bp, Artificial Sequence
  Description of Artificial Sequence: Synthetic oligonucleotide
gctctgcctggggtcccagc

SEQ ID NO: 10337 - DNA, 20 bp, Artificial Sequence
  Description of Artificial Sequence: Synthetic oligonucleotide
ctctgcctggggtcccagct

SEQ ID NO: 10338 - DNA, 20 bp, Artificial Sequence
  Description of Artificial Sequence: Synthetic oligonucleotide
tctgcctggggtcccagctc

SEQ ID NO: 10339 - DNA, 20 bp, Artificial Sequence
  Description of Artificial Sequence: Synthetic oligonucleotide
ctgcctggggtcccagctcc

SEQ ID NO: 10340 - DNA, 20 bp, Artificial Sequence
  Description of Artificial Sequence: Synthetic oligonucleotide
tgcctggggtcccagctcct

SEQ ID NO: 10341 - DNA, 20 bp, Artificial Sequence
  Description of Artificial Sequence: Synthetic oligonucleotide
gcctggggtcccagctccta

SEQ ID NO: 10342 - DNA, 20 bp, Artificial Sequence
  Description of Artificial Sequence: Synthetic oligonucleotide
cctggggtcccagctcctag

SEQ ID NO: 10343 - DNA, 20 bp, Artificial Sequence
  Description of Artificial Sequence: Synthetic oligonucleotide
ctggggtcccagctcctaga

SEQ ID NO: 10344 - DNA, 20 bp, Artificial Sequence
  Description of Artificial Sequence: Synthetic oligonucleotide
tggggtcccagctcctagag

SEQ ID NO: 10345 - DNA, 20 bp, Artificial Sequence
  Description of Artificial Sequence: Synthetic oligonucleotide
ggggtcccagctcctagagg

SEQ ID NO: 10346 - DNA, 20 bp, Artificial Sequence
  Description of Artificial Sequence: Synthetic oligonucleotide
gggtcccagctcctagaggg

SEQ ID NO: 10347 - DNA, 20 bp, Artificial Sequence
  Description of Artificial Sequence: Synthetic oligonucleotide
ggtcccagctcctagaggga

SEQ ID NO: 10348 - DNA, 20 bp, Artificial Sequence
  Description of Artificial Sequence: Synthetic oligonucleotide
gtcccagctcctagagggag

SEQ ID NO: 10349 - DNA, 20 bp, Artificial Sequence
  Description of Artificial Sequence: Synthetic oligonucleotide
tcccagctcctagagggaga

SEQ ID NO: 10350 - DNA, 20 bp, Artificial Sequence
  Description of Artificial Sequence: Synthetic oligonucleotide
cccagctcctagagggagag

SEQ ID NO: 10351 - DNA, 20 bp, Artificial Sequence
  Description of Artificial Sequence: Synthetic oligonucleotide
ccagctcctagagggagagg

SEQ ID NO: 10352 - DNA, 20 bp, Artificial Sequence
  Description of Artificial Sequence: Synthetic oligonucleotide
cagctcctagagggagagga

SEQ ID NO: 10353 - DNA, 20 bp, Artificial Sequence
  Description of Artificial Sequence: Synthetic oligonucleotide
agctcctagagggagaggag

SEQ ID NO: 10354 - DNA, 20 bp, Artificial Sequence
  Description of Artificial Sequence: Synthetic oligonucleotide
gctcctagagggagaggagg

SEQ ID NO: 10355 - DNA, 20 bp, Artificial Sequence
  Description of Artificial Sequence: Synthetic oligonucleotide
ctcctagagggagaggaggc

SEQ ID NO: 10356 - DNA, 20 bp, Artificial Sequence
  Description of Artificial Sequence: Synthetic oligonucleotide
tcctagagggagaggaggca

SEQ ID NO: 10357 - DNA, 20 bp, Artificial Sequence
  Description of Artificial Sequence: Synthetic oligonucleotide
cctagagggagaggaggcag

SEQ ID NO: 10358 - DNA, 20 bp, Artificial Sequence
  Description of Artificial Sequence: Synthetic oligonucleotide
ctagagggagaggaggcagg

SEQ ID NO: 10359 - DNA, 20 bp, Artificial Sequence
  Description of Artificial Sequence: Synthetic oligonucleotide
tagagggagaggaggcaggg

SEQ ID NO: 10360 - DNA, 20 bp, Artificial Sequence
  Description of Artificial Sequence: Synthetic oligonucleotide
agagggagaggaggcagggt

SEQ ID NO: 10361 - DNA, 20 bp, Artificial Sequence
  Description of Artificial Sequence: Synthetic oligonucleotide
gagggagaggaggcagggtt

SEQ ID NO: 10362 - DNA, 20 bp, Artificial Sequence
  Description of Artificial Sequence: Synthetic oligonucleotide
agggagaggaggcagggttg

SEQ ID NO: 10363 - DNA, 20 bp, Artificial Sequence
  Description of Artificial Sequence: Synthetic oligonucleotide
gggagaggaggcagggttga

SEQ ID NO: 10364 - DNA, 20 bp, Artificial Sequence
  Description of Artificial Sequence: Synthetic oligonucleotide
ggagaggaggcagggttgag

SEQ ID NO: 10365 - DNA, 20 bp, Artificial Sequence
  Description of Artificial Sequence: Synthetic oligonucleotide
gagaggaggcagggttgagg

SEQ ID NO: 10366 - DNA, 20 bp, Artificial Sequence
  Description of Artificial Sequence: Synthetic oligonucleotide
agaggaggcagggttgagga

SEQ ID NO: 10367 - DNA, 20 bp, Artificial Sequence
  Description of Artificial Sequence: Synthetic oligonucleotide
gaggaggcagggttgaggaa

SEQ ID NO: 10368 - DNA, 20 bp, Artificial Sequence
  Description of Artificial Sequence: Synthetic oligonucleotide
aggaggcagggttgaggaaa

SEQ ID NO: 10369 - DNA, 20 bp, Artificial Sequence
  Description of Artificial Sequence: Synthetic oligonucleotide
ggaggcagggttgaggaaag

SEQ ID NO: 10370 - DNA, 20 bp, Artificial Sequence
  Description of Artificial Sequence: Synthetic oligonucleotide
gaggcagggttgaggaaaga

SEQ ID NO: 10371 - DNA, 20 bp, Artificial Sequence
  Description of Artificial Sequence: Synthetic oligonucleotide
aggcagggttgaggaaagaa

SEQ ID NO: 10372 - DNA, 20 bp, Artificial Sequence
  Description of Artificial Sequence: Synthetic oligonucleotide
ggcagggttgaggaaagaaa

SEQ ID NO: 10373 - DNA, 20 bp, Artificial Sequence
  Description of Artificial Sequence: Synthetic oligonucleotide
gcagggttgaggaaagaaag

SEQ ID NO: 10374 - DNA, 20 bp, Artificial Sequence
  Description of Artificial Sequence: Synthetic oligonucleotide
cagggttgaggaaagaaaga

SEQ ID NO: 10375 - DNA, 20 bp, Artificial Sequence
  Description of Artificial Sequence: Synthetic oligonucleotide
agggttgaggaaagaaagag

SEQ ID NO: 10376 - DNA, 20 bp, Artificial Sequence
  Description of Artificial Sequence: Synthetic oligonucleotide
gggttgaggaaagaaagagg

SEQ ID NO: 10377 - DNA, 20 bp, Artificial Sequence
  Description of Artificial Sequence: Synthetic oligonucleotide
ggttgaggaaagaaagaggg

SEQ ID NO: 10378 - DNA, 20 bp, Artificial Sequence
  Description of Artificial Sequence: Synthetic oligonucleotide
gttgaggaaagaaagaggga

SEQ ID NO: 10379 - DNA, 20 bp, Artificial Sequence
  Description of Artificial Sequence: Synthetic oligonucleotide
ttgaggaaagaaagagggag

SEQ ID NO: 10380 - DNA, 20 bp, Artificial Sequence
  Description of Artificial Sequence: Synthetic oligonucleotide
tgaggaaagaaagagggagg

SEQ ID NO: 10381 - DNA, 20 bp, Artificial Sequence
  Description of Artificial Sequence: Synthetic oligonucleotide
gaggaaagaaagagggaggg

SEQ ID NO: 10382 - DNA, 20 bp, Artificial Sequence
  Description of Artificial Sequence: Synthetic oligonucleotide
aggaaagaaagagggaggga

SEQ ID NO: 10383 - DNA, 20 bp, Artificial Sequence
  Description of Artificial Sequence: Synthetic oligonucleotide
ggaaagaaagagggagggag

SEQ ID NO: 10384 - DNA, 20 bp, Artificial Sequence
  Description of Artificial Sequence: Synthetic oligonucleotide
gaaagaaagagggagggagg

SEQ ID NO: 10385 - DNA, 20 bp, Artificial Sequence
  Description of Artificial Sequence: Synthetic oligonucleotide
aaagaaagagggagggagga

SEQ ID NO: 10386 - DNA, 20 bp, Artificial Sequence
  Description of Artificial Sequence: Synthetic oligonucleotide
aagaaagagggagggaggag

SEQ ID NO: 10387 - DNA, 20 bp, Artificial Sequence
  Description of Artificial Sequence: Synthetic oligonucleotide
agaaagagggagggaggagg

SEQ ID NO: 10388 - DNA, 20 bp, Artificial Sequence
  Description of Artificial Sequence: Synthetic oligonucleotide
gaaagagggagggaggaggg

SEQ ID NO: 10389 - DNA, 20 bp, Artificial Sequence
  Description of Artificial Sequence: Synthetic oligonucleotide
aaagagggagggaggagggg

SEQ ID NO: 10390 - DNA, 20 bp, Artificial Sequence
  Description of Artificial Sequence: Synthetic oligonucleotide
aagagggagggaggagggga

SEQ ID NO: 10391 - DNA, 20 bp, Artificial Sequence
  Description of Artificial Sequence: Synthetic oligonucleotide
agagggagggaggaggggag

SEQ ID NO: 10392 - DNA, 20 bp, Artificial Sequence
  Description of Artificial Sequence: Synthetic oligonucleotide
gagggagggaggaggggagg

SEQ ID NO: 10393 - DNA, 20 bp, Artificial Sequence
  Description of Artificial Sequence: Synthetic oligonucleotide
agggagggaggaggggagga

SEQ ID NO: 10394 - DNA, 20 bp, Artificial Sequence
  Description of Artificial Sequence: Synthetic oligonucleotide
gggagggaggaggggaggat

SEQ ID NO: 10395 - DNA, 20 bp, Artificial Sequence
  Description of Artificial Sequence: Synthetic oligonucleotide
ggagggaggaggggaggatg

SEQ ID NO: 10396 - DNA, 20 bp, Artificial Sequence
  Description of Artificial Sequence: Synthetic oligonucleotide
gagggaggaggggaggatgg

SEQ ID NO: 10397 - DNA, 20 bp, Artificial Sequence
  Description of Artificial Sequence: Synthetic oligonucleotide
agggaggaggggaggatggc

SEQ ID NO: 10398 - DNA, 20 bp, Artificial Sequence
  Description of Artificial Sequence: Synthetic oligonucleotide
gggaggaggggaggatggcg

SEQ ID NO: 10399 - DNA, 20 bp, Artificial Sequence
  Description of Artificial Sequence: Synthetic oligonucleotide
ggaggaggggaggatggcgt

SEQ ID NO: 10400 - DNA, 20 bp, Artificial Sequence
  Description of Artificial Sequence: Synthetic oligonucleotide
gaggaggggaggatggcgtt

SEQ ID NO: 10401 - DNA, 20 bp, Artificial Sequence
  Description of Artificial Sequence: Synthetic oligonucleotide
aggaggggaggatggcgttg

SEQ ID NO: 10402 - DNA, 20 bp, Artificial Sequence
  Description of Artificial Sequence: Synthetic oligonucleotide
ggaggggaggatggcgttga

SEQ ID NO: 10403 - DNA, 20 bp, Artificial Sequence
  Description of Artificial Sequence: Synthetic oligonucleotide
gaggggaggatggcgttgag

SEQ ID NO: 10404 - DNA, 20 bp, Artificial Sequence
  Description of Artificial Sequence: Synthetic oligonucleotide
aggggaggatggcgttgagc

SEQ ID NO: 10405 - DNA, 20 bp, Artificial Sequence
  Description of Artificial Sequence: Synthetic oligonucleotide
ggggaggatggcgttgagca

SEQ ID NO: 10406 - DNA, 20 bp, Artificial Sequence
  Description of Artificial Sequence: Synthetic oligonucleotide
gggaggatggcgttgagcac

SEQ ID NO: 10407 - DNA, 20 bp, Artificial Sequence
  Description of Artificial Sequence: Synthetic oligonucleotide
ggaggatggcgttgagcacg

SEQ ID NO: 10408 - DNA, 20 bp, Artificial Sequence
  Description of Artificial Sequence: Synthetic oligonucleotide
gaggatggcgttgagcacgt

SEQ ID NO: 10409 - DNA, 20 bp, Artificial Sequence
  Description of Artificial Sequence: Synthetic oligonucleotide
aggatggcgttgagcacgtc

SEQ ID NO: 10410 - DNA, 20 bp, Artificial Sequence
  Description of Artificial Sequence: Synthetic oligonucleotide
ggatggcgttgagcacgtct

SEQ ID NO: 10411 - DNA, 20 bp, Artificial Sequence
  Description of Artificial Sequence: Synthetic oligonucleotide
gatggcgttgagcacgtctg

SEQ ID NO: 10412 - DNA, 20 bp, Artificial Sequence
  Description of Artificial Sequence: Synthetic oligonucleotide
atggcgttgagcacgtctgg

SEQ ID NO: 10413 - DNA, 20 bp, Artificial Sequence
  Description of Artificial Sequence: Synthetic oligonucleotide
tggcgttgagcacgtctgga

SEQ ID NO: 10414 - DNA, 20 bp, Artificial Sequence
  Description of Artificial Sequence: Synthetic oligonucleotide
ggcgttgagcacgtctggag

SEQ ID NO: 10415 - DNA, 20 bp, Artificial Sequence
  Description of Artificial Sequence: Synthetic oligonucleotide
gcgttgagcacgtctggagg

SEQ ID NO: 10416 - DNA, 20 bp, Artificial Sequence
  Description of Artificial Sequence: Synthetic oligonucleotide
cgttgagcacgtctggaggc

SEQ ID NO: 10417 - DNA, 20 bp, Artificial Sequence
  Description of Artificial Sequence: Synthetic oligonucleotide
gttgagcacgtctggaggct

SEQ ID NO: 10418 - DNA, 20 bp, Artificial Sequence
  Description of Artificial Sequence: Synthetic oligonucleotide
ttgagcacgtctggaggctc

SEQ ID NO: 10419 - DNA, 20 bp, Artificial Sequence
  Description of Artificial Sequence: Synthetic oligonucleotide
tgagcacgtctggaggctca

SEQ ID NO: 10420 - DNA, 20 bp, Artificial Sequence
  Description of Artificial Sequence: Synthetic oligonucleotide
gagcacgtctggaggctcag

SEQ ID NO: 10421 - DNA, 20 bp, Artificial Sequence
  Description of Artificial Sequence: Synthetic oligonucleotide
agcacgtctggaggctcaga

SEQ ID NO: 10422 - DNA, 20 bp, Artificial Sequence
  Description of Artificial Sequence: Synthetic oligonucleotide
gcacgtctggaggctcagac

SEQ ID NO: 10423 - DNA, 20 bp, Artificial Sequence
  Description of Artificial Sequence: Synthetic oligonucleotide
cacgtctggaggctcagacg

SEQ ID NO: 10424 - DNA, 20 bp, Artificial Sequence
  Description of Artificial Sequence: Synthetic oligonucleotide
acgtctggaggctcagacgc

SEQ ID NO: 10425 - DNA, 20 bp, Artificial Sequence
  Description of Artificial Sequence: Synthetic oligonucleotide
cgtctggaggctcagacgct

SEQ ID NO: 10426 - DNA, 20 bp, Artificial Sequence
  Description of Artificial Sequence: Synthetic oligonucleotide
gtctggaggctcagacgctc

SEQ ID NO: 10427 - DNA, 20 bp, Artificial Sequence
  Description of Artificial Sequence: Synthetic oligonucleotide
tctggaggctcagacgctcc

SEQ ID NO: 10428 - DNA, 20 bp, Artificial Sequence
  Description of Artificial Sequence: Synthetic oligonucleotide
ctggaggctcagacgctcca

SEQ ID NO: 10429 - DNA, 20 bp, Artificial Sequence
  Description of Artificial Sequence: Synthetic oligonucleotide
tggaggctcagacgctccag

SEQ ID NO: 10430 - DNA, 20 bp, Artificial Sequence
  Description of Artificial Sequence: Synthetic oligonucleotide
ggaggctcagacgctccaga

SEQ ID NO: 10431 - DNA, 20 bp, Artificial Sequence
  Description of Artificial Sequence: Synthetic oligonucleotide
gaggctcagacgctccagac

SEQ ID NO: 10432 - DNA, 20 bp, Artificial Sequence
  Description of Artificial Sequence: Synthetic oligonucleotide
aggctcagacgctccagact

SEQ ID NO: 10433 - DNA, 20 bp, Artificial Sequence
  Description of Artificial Sequence: Synthetic oligonucleotide
ggctcagacgctccagactg

SEQ ID NO: 10434 - DNA, 20 bp, Artificial Sequence
  Description of Artificial Sequence: Synthetic oligonucleotide
gctcagacgctccagactgg

SEQ ID NO: 10435 - DNA, 20 bp, Artificial Sequence
  Description of Artificial Sequence: Synthetic oligonucleotide
ctcagacgctccagactggg

SEQ ID NO: 10436 - DNA, 20 bp, Artificial Sequence
  Description of Artificial Sequence: Synthetic oligonucleotide
tcagacgctccagactggga

SEQ ID NO: 10437 - DNA, 20 bp, Artificial Sequence
  Description of Artificial Sequence: Synthetic oligonucleotide
cagacgctccagactgggag

SEQ ID NO: 10438 - DNA, 20 bp, Artificial Sequence
  Description of Artificial Sequence: Synthetic oligonucleotide
agacgctccagactgggagg

SEQ ID NO: 10439 - DNA, 20 bp, Artificial Sequence
  Description of Artificial Sequence: Synthetic oligonucleotide
gacgctccagactgggagga

SEQ ID NO: 10440 - DNA, 20 bp, Artificial Sequence
  Description of Artificial Sequence: Synthetic oligonucleotide
acgctccagactgggaggaa

SEQ ID NO: 10441 - DNA, 20 bp, Artificial Sequence
  Description of Artificial Sequence: Synthetic oligonucleotide
cgctccagactgggaggaac

SEQ ID NO: 10442 - DNA, 20 bp, Artificial Sequence
  Description of Artificial Sequence: Synthetic oligonucleotide
gctccagactgggaggaacc

SEQ ID NO: 10443 - DNA, 20 bp, Artificial Sequence
  Description of Artificial Sequence: Synthetic oligonucleotide
ctccagactgggaggaaccg

SEQ ID NO: 10444 - DNA, 20 bp, Artificial Sequence
  Description of Artificial Sequence: Synthetic oligonucleotide
tccagactgggaggaaccgc

SEQ ID NO: 10445 - DNA, 20 bp, Artificial Sequence
  Description of Artificial Sequence: Synthetic oligonucleotide
ccagactgggaggaaccgcc

SEQ ID NO: 10446 - DNA, 20 bp, Artificial Sequence
  Description of Artificial Sequence: Synthetic oligonucleotide
cagactgggaggaaccgccc

SEQ ID NO: 10447 - DNA, 20 bp, Artificial Sequence
  Description of Artificial Sequence: Synthetic oligonucleotide
agactgggaggaaccgcccc

SEQ ID NO: 10448 - DNA, 20 bp, Artificial Sequence
  Description of Artificial Sequence: Synthetic oligonucleotide
gactgggaggaaccgccccc

SEQ ID NO: 10449 - DNA, 20 bp, Artificial Sequence
  Description of Artificial Sequence: Synthetic oligonucleotide
actgggaggaaccgccccca

SEQ ID NO: 10450 - DNA, 20 bp, Artificial Sequence
  Description of Artificial Sequence: Synthetic oligonucleotide
ctgggaggaaccgcccccag

SEQ ID NO: 10451 - DNA, 20 bp, Artificial Sequence
  Description of Artificial Sequence: Synthetic oligonucleotide
tgggaggaaccgcccccagc

SEQ ID NO: 10452 - DNA, 20 bp, Artificial Sequence
  Description of Artificial Sequence: Synthetic oligonucleotide
gggaggaaccgcccccagcc

SEQ ID NO: 10453 - DNA, 20 bp, Artificial Sequence
  Description of Artificial Sequence: Synthetic oligonucleotide
ggaggaaccgcccccagccc

SEQ ID NO: 10454 - DNA, 20 bp, Artificial Sequence
  Description of Artificial Sequence: Synthetic oligonucleotide
gaggaaccgcccccagccca

SEQ ID NO: 10455 - DNA, 20 bp, Artificial Sequence
  Description of Artificial Sequence: Synthetic oligonucleotide
aggaaccgcccccagcccag

SEQ ID NO: 10456 - DNA, 20 bp, Artificial Sequence
  Description of Artificial Sequence: Synthetic oligonucleotide
ggaaccgcccccagcccagc

SEQ ID NO: 10457 - DNA, 20 bp, Artificial Sequence
  Description of Artificial Sequence: Synthetic oligonucleotide
gaaccgcccccagcccagcc

SEQ ID NO: 10458 - DNA, 20 bp, Artificial Sequence
  Description of Artificial Sequence: Synthetic oligonucleotide
aaccgcccccagcccagccg

SEQ ID NO: 10459 - DNA, 20 bp, Artificial Sequence
  Description of Artificial Sequence: Synthetic oligonucleotide
accgcccccagcccagccgg

SEQ ID NO: 10460 - DNA, 20 bp, Artificial Sequence
  Description of Artificial Sequence: Synthetic oligonucleotide
ccgcccccagcccagccgga

SEQ ID NO: 10461 - DNA, 20 bp, Artificial Sequence
  Description of Artificial Sequence: Synthetic oligonucleotide
cgcccccagcccagccggaa

SEQ ID NO: 10462 - DNA, 20 bp, Artificial Sequence
  Description of Artificial Sequence: Synthetic oligonucleotide
gcccccagcccagccggaaa

SEQ ID NO: 10463 - DNA, 20 bp, Artificial Sequence
  Description of Artificial Sequence: Synthetic oligonucleotide
cccccagcccagccggaaaa

SEQ ID NO: 10464 - DNA, 20 bp, Artificial Sequence
  Description of Artificial Sequence: Synthetic oligonucleotide
ccccagcccagccggaaaag

SEQ ID NO: 10465 - DNA, 20 bp, Artificial Sequence
  Description of Artificial Sequence: Synthetic oligonucleotide
cccagcccagccggaaaagt

SEQ ID NO: 10466 - DNA, 20 bp, Artificial Sequence
  Description of Artificial Sequence: Synthetic oligonucleotide
ccagcccagccggaaaagta

SEQ ID NO: 10467 - DNA, 20 bp, Artificial Sequence
  Description of Artificial Sequence: Synthetic oligonucleotide
cagcccagccggaaaagtag

SEQ ID NO: 10468 - DNA, 20 bp, Artificial Sequence
  Description of Artificial Sequence: Synthetic oligonucleotide
agcccagccggaaaagtagg

SEQ ID NO: 10469 - DNA, 20 bp, Artificial Sequence
  Description of Artificial Sequence: Synthetic oligonucleotide
gcccagccggaaaagtaggg

SEQ ID NO: 10470 - DNA, 20 bp, Artificial Sequence
  Description of Artificial Sequence: Synthetic oligonucleotide
cccagccggaaaagtagggg

SEQ ID NO: 10471 - DNA, 20 bp, Artificial Sequence
  Description of Artificial Sequence: Synthetic oligonucleotide
ccagccggaaaagtagggga

SEQ ID NO: 10472 - DNA, 20 bp, Artificial Sequence
  Description of Artificial Sequence: Synthetic oligonucleotide
cagccggaaaagtaggggaa

SEQ ID NO: 10473 - DNA, 20 bp, Artificial Sequence
  Description of Artificial Sequence: Synthetic oligonucleotide
agccggaaaagtaggggaaa

SEQ ID NO: 10474 - DNA, 20 bp, Artificial Sequence
  Description of Artificial Sequence: Synthetic oligonucleotide
gccggaaaagtaggggaaag

SEQ ID NO: 10475 - DNA, 20 bp, Artificial Sequence
  Description of Artificial Sequence: Synthetic oligonucleotide
ccggaaaagtaggggaaagg

SEQ ID NO: 10476 - DNA, 20 bp, Artificial Sequence
  Description of Artificial Sequence: Synthetic oligonucleotide
cggaaaagtaggggaaaggt

SEQ ID NO: 10477 - DNA, 20 bp, Artificial Sequence
  Description of Artificial Sequence: Synthetic oligonucleotide
ggaaaagtaggggaaaggtc

SEQ ID NO: 10478 - DNA, 20 bp, Artificial Sequence
  Description of Artificial Sequence: Synthetic oligonucleotide
gaaaagtaggggaaaggtcg

SEQ ID NO: 10479 - DNA, 20 bp, Artificial Sequence
  Description of Artificial Sequence: Synthetic oligonucleotide
aaaagtaggggaaaggtcga

SEQ ID NO: 10480 - DNA, 20 bp, Artificial Sequence
  Description of Artificial Sequence: Synthetic oligonucleotide
aaagtaggggaaaggtcgaa

SEQ ID NO: 10481 - DNA, 20 bp, Artificial Sequence
  Description of Artificial Sequence: Synthetic oligonucleotide
aagtaggggaaaggtcgaaa

SEQ ID NO: 10482 - DNA, 20 bp, Artificial Sequence
  Description of Artificial Sequence: Synthetic oligonucleotide
agtaggggaaaggtcgaaat

SEQ ID NO: 10483 - DNA, 20 bp, Artificial Sequence
  Description of Artificial Sequence: Synthetic oligonucleotide
gtaggggaaaggtcgaaatg

SEQ ID NO: 10484 - DNA, 20 bp, Artificial Sequence
  Description of Artificial Sequence: Synthetic oligonucleotide
taggggaaaggtcgaaatga

SEQ ID NO: 10485 - DNA, 20 bp, Artificial Sequence
  Description of Artificial Sequence: Synthetic oligonucleotide
aggggaaaggtcgaaatgag

SEQ ID NO: 10486 - DNA, 20 bp, Artificial Sequence
  Description of Artificial Sequence: Synthetic oligonucleotide
ggggaaaggtcgaaatgagt

SEQ ID NO: 10487 - DNA, 20 bp, Artificial Sequence
  Description of Artificial Sequence: Synthetic oligonucleotide
gggaaaggtcgaaatgagtc

SEQ ID NO: 10488 - DNA, 20 bp, Artificial Sequence
  Description of Artificial Sequence: Synthetic oligonucleotide
ggaaaggtcgaaatgagtct

SEQ ID NO: 10489 - DNA, 20 bp, Artificial Sequence
  Description of Artificial Sequence: Synthetic oligonucleotide
gaaaggtcgaaatgagtctg

SEQ ID NO: 10490 - DNA, 20 bp, Artificial Sequence
  Description of Artificial Sequence: Synthetic oligonucleotide
aaaggtcgaaatgagtctgc

SEQ ID NO: 10491 - DNA, 20 bp, Artificial Sequence
  Description of Artificial Sequence: Synthetic oligonucleotide
aaggtcgaaatgagtctgca

SEQ ID NO: 10492 - DNA, 20 bp, Artificial Sequence
  Description of Artificial Sequence: Synthetic oligonucleotide
aggtcgaaatgagtctgcac

SEQ ID NO: 10493 - DNA, 20 bp, Artificial Sequence
  Description of Artificial Sequence: Synthetic oligonucleotide
ggtcgaaatgagtctgcacg

SEQ ID NO: 10494 - DNA, 20 bp, Artificial Sequence
  Description of Artificial Sequence: Synthetic oligonucleotide
gtcgaaatgagtctgcacgg

SEQ ID NO: 10495 - DNA, 20 bp, Artificial Sequence
  Description of Artificial Sequence: Synthetic oligonucleotide
tcgaaatgagtctgcacggt

SEQ ID NO: 10496 - DNA, 20 bp, Artificial Sequence
  Description of Artificial Sequence: Synthetic oligonucleotide
cgaaatgagtctgcacggtg

SEQ ID NO: 10497 - DNA, 20 bp, Artificial Sequence
  Description of Artificial Sequence: Synthetic oligonucleotide
gaaatgagtctgcacggtgg

SEQ ID NO: 10498 - DNA, 20 bp, Artificial Sequence
  Description of Artificial Sequence: Synthetic oligonucleotide
aaatgagtctgcacggtggg

SEQ ID NO: 10499 - DNA, 20 bp, Artificial Sequence
  Description of Artificial Sequence: Synthetic oligonucleotide
aatgagtctgcacggtgggg

SEQ ID NO: 10500 - DNA, 20 bp, Artificial Sequence
  Description of Artificial Sequence: Synthetic oligonucleotide
atgagtctgcacggtggggg

SEQ ID NO: 10501 - DNA, 20 bp, Artificial Sequence
  Description of Artificial Sequence: Synthetic oligonucleotide
tgagtctgcacggtgggggt

SEQ ID NO: 10502 - DNA, 20 bp, Artificial Sequence
  Description of Artificial Sequence: Synthetic oligonucleotide
gagtctgcacggtgggggtg

SEQ ID NO: 10503 - DNA, 20 bp, Artificial Sequence
  Description of Artificial Sequence: Synthetic oligonucleotide
agtctgcacggtgggggtgg

SEQ ID NO: 10504 - DNA, 20 bp, Artificial Sequence
  Description of Artificial Sequence: Synthetic oligonucleotide
gtctgcacggtgggggtggg

SEQ ID NO: 10505 - DNA, 20 bp, Artificial Sequence
  Description of Artificial Sequence: Synthetic oligonucleotide
tctgcacggtgggggtgggg

SEQ ID NO: 10506 - DNA, 20 bp, Artificial Sequence
  Description of Artificial Sequence: Synthetic oligonucleotide
ctgcacggtgggggtggggg

SEQ ID NO: 10507 - DNA, 20 bp, Artificial Sequence
  Description of Artificial Sequence: Synthetic oligonucleotide
tgcacggtgggggtgggggc

SEQ ID NO: 10508 - DNA, 20 bp, Artificial Sequence
  Description of Artificial Sequence: Synthetic oligonucleotide
gcacggtgggggtgggggcg

SEQ ID NO: 10509 - DNA, 20 bp, Artificial Sequence
  Description of Artificial Sequence: Synthetic oligonucleotide
cacggtgggggtgggggcgg

SEQ ID NO: 10510 - DNA, 20 bp, Artificial Sequence
  Description of Artificial Sequence: Synthetic oligonucleotide
acggtgggggtgggggcggg

SEQ ID NO: 10511 - DNA, 20 bp, Artificial Sequence
  Description of Artificial Sequence: Synthetic oligonucleotide
cggtgggggtgggggcgggc

SEQ ID NO: 10512 - DNA, 20 bp, Artificial Sequence
  Description of Artificial Sequence: Synthetic oligonucleotide
ggtgggggtgggggcgggcc

SEQ ID NO: 10513 - DNA, 20 bp, Artificial Sequence
  Description of Artificial Sequence: Synthetic oligonucleotide
gtgggggtgggggcgggccc

SEQ ID NO: 10514 - DNA, 20 bp, Artificial Sequence
  Description of Artificial Sequence: Synthetic oligonucleotide
tgggggtgggggcgggccca

SEQ ID NO: 10515 - DNA, 20 bp, Artificial Sequence
  Description of Artificial Sequence: Synthetic oligonucleotide
gggggtgggggcgggcccag

SEQ ID NO: 10516 - DNA, 20 bp, Artificial Sequence
  Description of Artificial Sequence: Synthetic oligonucleotide
ggggtgggggcgggcccaga

SEQ ID NO: 10517 - DNA, 20 bp, Artificial Sequence
  Description of Artificial Sequence: Synthetic oligonucleotide
gggtgggggcgggcccagag

SEQ ID NO: 10518 - DNA, 20 bp, Artificial Sequence
  Description of Artificial Sequence: Synthetic oligonucleotide
ggtgggggcgggcccagagt

SEQ ID NO: 10519 - DNA, 20 bp, Artificial Sequence
  Description of Artificial Sequence: Synthetic oligonucleotide
gtgggggcgggcccagagtg

SEQ ID NO: 10520 - DNA, 20 bp, Artificial Sequence
  Description of Artificial Sequence: Synthetic oligonucleotide
tgggggcgggcccagagtga

SEQ ID NO: 10521 - DNA, 20 bp, Artificial Sequence
  Description of Artificial Sequence: Synthetic oligonucleotide
gggggcgggcccagagtgac

SEQ ID NO: 10522 - DNA, 20 bp, Artificial Sequence
  Description of Artificial Sequence: Synthetic oligonucleotide
ggggcgggcccagagtgacc

SEQ ID NO: 10523 - DNA, 20 bp, Artificial Sequence
  Description of Artificial Sequence: Synthetic oligonucleotide
gggcgggcccagagtgacca

SEQ ID NO: 10524 - DNA, 20 bp, Artificial Sequence
  Description of Artificial Sequence: Synthetic oligonucleotide
ggcgggcccagagtgaccag

SEQ ID NO: 10525 - DNA, 20 bp, Artificial Sequence
  Description of Artificial Sequence: Synthetic oligonucleotide
gcgggcccagagtgaccagg

SEQ ID NO: 10526 - DNA, 20 bp, Artificial Sequence
  Description of Artificial Sequence: Synthetic oligonucleotide
cgggcccagagtgaccagga

SEQ ID NO: 10527 - DNA, 20 bp, Artificial Sequence
  Description of Artificial Sequence: Synthetic oligonucleotide
gggcccagagtgaccaggaa

SEQ ID NO: 10528 - DNA, 20 bp, Artificial Sequence
  Description of Artificial Sequence: Synthetic oligonucleotide
ggcccagagtgaccaggaag

SEQ ID NO: 10529 - DNA, 20 bp, Artificial Sequence
  Description of Artificial Sequence: Synthetic oligonucleotide
gcccagagtgaccaggaaga

SEQ ID NO: 10530 - DNA, 20 bp, Artificial Sequence
  Description of Artificial Sequence: Synthetic oligonucleotide
cccagagtgaccaggaagac

SEQ ID NO: 10531 - DNA, 20 bp, Artificial Sequence
  Description of Artificial Sequence: Synthetic oligonucleotide
ccagagtgaccaggaagacg

SEQ ID NO: 10532 - DNA, 20 bp, Artificial Sequence
  Description of Artificial Sequence: Synthetic oligonucleotide
cagagtgaccaggaagacgc

SEQ ID NO: 10533 - DNA, 20 bp, Artificial Sequence
  Description of Artificial Sequence: Synthetic oligonucleotide
agagtgaccaggaagacgct

SEQ ID NO: 10534 - DNA, 20 bp, Artificial Sequence
  Description of Artificial Sequence: Synthetic oligonucleotide
gagtgaccaggaagacgctt

SEQ ID NO: 10535 - DNA, 20 bp, Artificial Sequence
  Description of Artificial Sequence: Synthetic oligonucleotide
agtgaccaggaagacgcttt

SEQ ID NO: 10536 - DNA, 20 bp, Artificial Sequence
  Description of Artificial Sequence: Synthetic oligonucleotide
gtgaccaggaagacgctttc

SEQ ID NO: 10537 - DNA, 20 bp, Artificial Sequence
  Description of Artificial Sequence: Synthetic oligonucleotide
tgaccaggaagacgctttcc

SEQ ID NO: 10538 - DNA, 20 bp, Artificial Sequence
  Description of Artificial Sequence: Synthetic oligonucleotide
gaccaggaagacgctttccg

SEQ ID NO: 10539 - DNA, 20 bp, Artificial Sequence
  Description of Artificial Sequence: Synthetic oligonucleotide
accaggaagacgctttccgg

SEQ ID NO: 10540 - DNA, 20 bp, Artificial Sequence
  Description of Artificial Sequence: Synthetic oligonucleotide
ccaggaagacgctttccggc

SEQ ID NO: 10541 - DNA, 20 bp, Artificial Sequence
  Description of Artificial Sequence: Synthetic oligonucleotide
caggaagacgctttccggcc

SEQ ID NO: 10542 - DNA, 20 bp, Artificial Sequence
  Description of Artificial Sequence: Synthetic oligonucleotide
aggaagacgctttccggccc

SEQ ID NO: 10543 - DNA, 20 bp, Artificial Sequence
  Description of Artificial Sequence: Synthetic oligonucleotide
ggaagacgctttccggcccc

SEQ ID NO: 10544 - DNA, 20 bp, Artificial Sequence
  Description of Artificial Sequence: Synthetic oligonucleotide
gaagacgctttccggcccct

SEQ ID NO: 10545 - DNA, 20 bp, Artificial Sequence
  Description of Artificial Sequence: Synthetic oligonucleotide
aagacgctttccggcccctc

SEQ ID NO: 10546 - DNA, 20 bp, Artificial Sequence
  Description of Artificial Sequence: Synthetic oligonucleotide
agacgctttccggcccctca

SEQ ID NO: 10547 - DNA, 20 bp, Artificial Sequence
  Description of Artificial Sequence: Synthetic oligonucleotide
gacgctttccggcccctcag

SEQ ID NO: 10548 - DNA, 20 bp, Artificial Sequence
  Description of Artificial Sequence: Synthetic oligonucleotide
acgctttccggcccctcagg

SEQ ID NO: 10549 - DNA, 20 bp, Artificial Sequence
  Description of Artificial Sequence: Synthetic oligonucleotide
cgctttccggcccctcaggc

SEQ ID NO: 10550 - DNA, 20 bp, Artificial Sequence
  Description of Artificial Sequence: Synthetic oligonucleotide
gctttccggcccctcaggca

SEQ ID NO: 10551 - DNA, 20 bp, Artificial Sequence
  Description of Artificial Sequence: Synthetic oligonucleotide
ctttccggcccctcaggcat

SEQ ID NO: 10552 - DNA, 20 bp, Artificial Sequence
  Description of Artificial Sequence: Synthetic oligonucleotide
tttccggcccctcaggcatc

SEQ ID NO: 10553 - DNA, 20 bp, Artificial Sequence
  Description of Artificial Sequence: Synthetic oligonucleotide
ttccggcccctcaggcatct

SEQ ID NO: 10554 - DNA, 20 bp, Artificial Sequence
  Description of Artificial Sequence: Synthetic oligonucleotide
tccggcccctcaggcatctc

SEQ ID NO: 10555 - DNA, 20 bp, Artificial Sequence
  Description of Artificial Sequence: Synthetic oligonucleotide
ccggcccctcaggcatctcc

SEQ ID NO: 10556 - DNA, 20 bp, Artificial Sequence
  Description of Artificial Sequence: Synthetic oligonucleotide
cggcccctcaggcatctccc

SEQ ID NO: 10557 - DNA, 20 bp, Artificial Sequence
  Description of Artificial Sequence: Synthetic oligonucleotide
ggcccctcaggcatctcccc

SEQ ID NO: 10558 - DNA, 20 bp, Artificial Sequence
  Description of Artificial Sequence: Synthetic oligonucleotide
gcccctcaggcatctcccct

SEQ ID NO: 10559 - DNA, 20 bp, Artificial Sequence
  Description of Artificial Sequence: Synthetic oligonucleotide
cccctcaggcatctcccctt

SEQ ID NO: 10560 - DNA, 20 bp, Artificial Sequence
  Description of Artificial Sequence: Synthetic oligonucleotide
ccctcaggcatctccccttt

SEQ ID NO: 10561 - DNA, 20 bp, Artificial Sequence
  Description of Artificial Sequence: Synthetic oligonucleotide
cctcaggcatctcccctttc

SEQ ID NO: 10562 - DNA, 20 bp, Artificial Sequence
  Description of Artificial Sequence: Synthetic oligonucleotide
ctcaggcatctcccctttcc

SEQ ID NO: 10563 - DNA, 20 bp, Artificial Sequence
  Description of Artificial Sequence: Synthetic oligonucleotide
tcaggcatctcccctttccc

SEQ ID NO: 10564 - DNA, 20 bp, Artificial Sequence
  Description of Artificial Sequence: Synthetic oligonucleotide
caggcatctcccctttcccc

SEQ ID NO: 10565 - DNA, 20 bp, Artificial Sequence
  Description of Artificial Sequence: Synthetic oligonucleotide
aggcatctcccctttcccct

SEQ ID NO: 10566 - DNA, 20 bp, Artificial Sequence
  Description of Artificial Sequence: Synthetic oligonucleotide
ggcatctcccctttccccta

SEQ ID NO: 10567 - DNA, 20 bp, Artificial Sequence
  Description of Artificial Sequence: Synthetic oligonucleotide
gcatctcccctttcccctac

SEQ ID NO: 10568 - DNA, 20 bp, Artificial Sequence
  Description of Artificial Sequence: Synthetic oligonucleotide
catctcccctttcccctact

SEQ ID NO: 10569 - DNA, 20 bp, Artificial Sequence
  Description of Artificial Sequence: Synthetic oligonucleotide
atctcccctttcccctactt

SEQ ID NO: 10570 - DNA, 20 bp, Artificial Sequence
  Description of Artificial Sequence: Synthetic oligonucleotide
tctcccctttcccctacttt

SEQ ID NO: 10571 - DNA, 20 bp, Artificial Sequence
  Description of Artificial Sequence: Synthetic oligonucleotide
ctcccctttcccctactttc

SEQ ID NO: 10572 - DNA, 20 bp, Artificial Sequence
  Description of Artificial Sequence: Synthetic oligonucleotide
tcccctttcccctactttcc

SEQ ID NO: 10573 - DNA, 20 bp, Artificial Sequence
  Description of Artificial Sequence: Synthetic oligonucleotide
cccctttcccctactttcct

SEQ ID NO: 10574 - DNA, 20 bp, Artificial Sequence
  Description of Artificial Sequence: Synthetic oligonucleotide
ccctttcccctactttcctc

SEQ ID NO: 10575 - DNA, 20 bp, Artificial Sequence
  Description of Artificial Sequence: Synthetic oligonucleotide
cctttcccctactttcctcc

SEQ ID NO: 10576 - DNA, 20 bp, Artificial Sequence
  Description of Artificial Sequence: Synthetic oligonucleotide
ctttcccctactttcctccc

SEQ ID NO: 10577 - DNA, 20 bp, Artificial Sequence
  Description of Artificial Sequence: Synthetic oligonucleotide
tttcccctactttcctccca

SEQ ID NO: 10578 - DNA, 20 bp, Artificial Sequence
  Description of Artificial Sequence: Synthetic oligonucleotide
ttcccctactttcctcccat

SEQ ID NO: 10579 - DNA, 20 bp, Artificial Sequence
  Description of Artificial Sequence: Synthetic oligonucleotide
tcccctactttcctcccatc

SEQ ID NO: 10580 - DNA, 20 bp, Artificial Sequence
  Description of Artificial Sequence: Synthetic oligonucleotide
cccctactttcctcccatcc

SEQ ID NO: 10581 - DNA, 20 bp, Artificial Sequence
  Description of Artificial Sequence: Synthetic oligonucleotide
ccctactttcctcccatcca

SEQ ID NO: 10582 - DNA, 20 bp, Artificial Sequence
  Description of Artificial Sequence: Synthetic oligonucleotide
cctactttcctcccatccag

SEQ ID NO: 10583 - DNA, 20 bp, Artificial Sequence
  Description of Artificial Sequence: Synthetic oligonucleotide
ctactttcctcccatccagt

SEQ ID NO: 10584 - DNA, 20 bp, Artificial Sequence
  Description of Artificial Sequence: Synthetic oligonucleotide
tactttcctcccatccagta

SEQ ID NO: 10585 - DNA, 20 bp, Artificial Sequence
  Description of Artificial Sequence: Synthetic oligonucleotide
actttcctcccatccagtaa

SEQ ID NO: 10586 - DNA, 20 bp, Artificial Sequence
  Description of Artificial Sequence: Synthetic oligonucleotide
ctttcctcccatccagtaag

SEQ ID NO: 10587 - DNA, 20 bp, Artificial Sequence
  Description of Artificial Sequence: Synthetic oligonucleotide
tttcctcccatccagtaagg

SEQ ID NO: 10588 - DNA, 20 bp, Artificial Sequence
  Description of Artificial Sequence: Synthetic oligonucleotide
ttcctcccatccagtaagga

SEQ ID NO: 10589 - DNA, 20 bp, Artificial Sequence
  Description of Artificial Sequence: Synthetic oligonucleotide
tcctcccatccagtaaggat

SEQ ID NO: 10590 - DNA, 20 bp, Artificial Sequence
  Description of Artificial Sequence: Synthetic oligonucleotide
cctcccatccagtaaggatg

SEQ ID NO: 10591 - DNA, 20 bp, Artificial Sequence
  Description of Artificial Sequence: Synthetic oligonucleotide
ctcccatccagtaaggatgg

SEQ ID NO: 10592 - DNA, 20 bp, Artificial Sequence
  Description of Artificial Sequence: Synthetic oligonucleotide
tcccatccagtaaggatggg

SEQ ID NO: 10593 - DNA, 20 bp, Artificial Sequence
  Description of Artificial Sequence: Synthetic oligonucleotide
cccatccagtaaggatgggc

SEQ ID NO: 10594 - DNA, 20 bp, Artificial Sequence
  Description of Artificial Sequence: Synthetic oligonucleotide
ccatccagtaaggatgggca

SEQ ID NO: 10595 - DNA, 20 bp, Artificial Sequence
  Description of Artificial Sequence: Synthetic oligonucleotide
catccagtaaggatgggcac

SEQ ID NO: 10596 - DNA, 20 bp, Artificial Sequence
  Description of Artificial Sequence: Synthetic oligonucleotide
atccagtaaggatgggcacg

SEQ ID NO: 10597 - DNA, 20 bp, Artificial Sequence
  Description of Artificial Sequence: Synthetic oligonucleotide
tccagtaaggatgggcacgc

SEQ ID NO: 10598 - DNA, 20 bp, Artificial Sequence
  Description of Artificial Sequence: Synthetic oligonucleotide
ccagtaaggatgggcacgcg

SEQ ID NO: 10599 - DNA, 20 bp, Artificial Sequence
  Description of Artificial Sequence: Synthetic oligonucleotide
cagtaaggatgggcacgcgg

SEQ ID NO: 10600 - DNA, 20 bp, Artificial Sequence
  Description of Artificial Sequence: Synthetic oligonucleotide
agtaaggatgggcacgcggc

SEQ ID NO: 10601 - DNA, 20 bp, Artificial Sequence
  Description of Artificial Sequence: Synthetic oligonucleotide
gtaaggatgggcacgcggcc

SEQ ID NO: 10602 - DNA, 20 bp, Artificial Sequence
  Description of Artificial Sequence: Synthetic oligonucleotide
taaggatgggcacgcggcca

SEQ ID NO: 10603 - DNA, 20 bp, Artificial Sequence
  Description of Artificial Sequence: Synthetic oligonucleotide
aaggatgggcacgcggccaa

SEQ ID NO: 10604 - DNA, 20 bp, Artificial Sequence
  Description of Artificial Sequence: Synthetic oligonucleotide
aggatgggcacgcggccaaa

SEQ ID NO: 10605 - DNA, 20 bp, Artificial Sequence
  Description of Artificial Sequence: Synthetic oligonucleotide
ggatgggcacgcggccaaac

SEQ ID NO: 10606 - DNA, 20 bp, Artificial Sequence
  Description of Artificial Sequence: Synthetic oligonucleotide
gatgggcacgcggccaaacc

SEQ ID NO: 10607 - DNA, 20 bp, Artificial Sequence
  Description of Artificial Sequence: Synthetic oligonucleotide
atgggcacgcggccaaacca

SEQ ID NO: 10608 - DNA, 20 bp, Artificial Sequence
  Description of Artificial Sequence: Synthetic oligonucleotide
tgggcacgcggccaaaccac

SEQ ID NO: 10609 - DNA, 20 bp, Artificial Sequence
  Description of Artificial Sequence: Synthetic oligonucleotide
gggcacgcggccaaaccacc

SEQ ID NO: 10610 - DNA, 20 bp, Artificial Sequence
  Description of Artificial Sequence: Synthetic oligonucleotide
ggcacgcggccaaaccacca

SEQ ID NO: 10611 - DNA, 20 bp, Artificial Sequence
  Description of Artificial Sequence: Synthetic oligonucleotide
gcacgcggccaaaccaccag

SEQ ID NO: 10612 - DNA, 20 bp, Artificial Sequence
  Description of Artificial Sequence: Synthetic oligonucleotide
cacgcggccaaaccaccagt

SEQ ID NO: 10613 - DNA, 20 bp, Artificial Sequence
  Description of Artificial Sequence: Synthetic oligonucleotide
acgcggccaaaccaccagtg

SEQ ID NO: 10614 - DNA, 20 bp, Artificial Sequence
  Description of Artificial Sequence: Synthetic oligonucleotide
cgcggccaaaccaccagtgt

SEQ ID NO: 10615 - DNA, 20 bp, Artificial Sequence
  Description of Artificial Sequence: Synthetic oligonucleotide
gcggccaaaccaccagtgtg

SEQ ID NO: 10616 - DNA, 20 bp, Artificial Sequence
  Description of Artificial Sequence: Synthetic oligonucleotide
cggccaaaccaccagtgtgg

SEQ ID NO: 10617 - DNA, 20 bp, Artificial Sequence
  Description of Artificial Sequence: Synthetic oligonucleotide
ggccaaaccaccagtgtggc

SEQ ID NO: 10618 - DNA, 20 bp, Artificial Sequence
  Description of Artificial Sequence: Synthetic oligonucleotide
gccaaaccaccagtgtggct

SEQ ID NO: 10619 - DNA, 20 bp, Artificial Sequence
  Description of Artificial Sequence: Synthetic oligonucleotide
ccaaaccaccagtgtggctt

SEQ ID NO: 10620 - DNA, 20 bp, Artificial Sequence
  Description of Artificial Sequence: Synthetic oligonucleotide
caaaccaccagtgtggcttc

SEQ ID NO: 10621 - DNA, 20 bp, Artificial Sequence
  Description of Artificial Sequence: Synthetic oligonucleotide
aaaccaccagtgtggcttcc

SEQ ID NO: 10622 - DNA, 20 bp, Artificial Sequence
  Description of Artificial Sequence: Synthetic oligonucleotide
aaccaccagtgtggcttcca

SEQ ID NO: 10623 - DNA, 20 bp, Artificial Sequence
  Description of Artificial Sequence: Synthetic oligonucleotide
accaccagtgtggcttccat

SEQ ID NO: 10624 - DNA, 20 bp, Artificial Sequence
  Description of Artificial Sequence: Synthetic oligonucleotide
ccaccagtgtggcttccatg

SEQ ID NO: 10625 - DNA, 20 bp, Artificial Sequence
  Description of Artificial Sequence: Synthetic oligonucleotide
caccagtgtggcttccatga

SEQ ID NO: 10626 - DNA, 20 bp, Artificial Sequence
  Description of Artificial Sequence: Synthetic oligonucleotide
accagtgtggcttccatgaa

SEQ ID NO: 10627 - DNA, 20 bp, Artificial Sequence
  Description of Artificial Sequence: Synthetic oligonucleotide
ccagtgtggcttccatgaat

SEQ ID NO: 10628 - DNA, 20 bp, Artificial Sequence
  Description of Artificial Sequence: Synthetic oligonucleotide
cagtgtggcttccatgaatg

SEQ ID NO: 10629 - DNA, 20 bp, Artificial Sequence
  Description of Artificial Sequence: Synthetic oligonucleotide
agtgtggcttccatgaatgc

SEQ ID NO: 10630 - DNA, 20 bp, Artificial Sequence
  Description of Artificial Sequence: Synthetic oligonucleotide
gtgtggcttccatgaatgcc

SEQ ID NO: 10631 - DNA, 20 bp, Artificial Sequence
  Description of Artificial Sequence: Synthetic oligonucleotide
tgtggcttccatgaatgcca

SEQ ID NO: 10632 - DNA, 20 bp, Artificial Sequence
  Description of Artificial Sequence: Synthetic oligonucleotide
gtggcttccatgaatgccag

SEQ ID NO: 10633 - DNA, 20 bp, Artificial Sequence
  Description of Artificial Sequence: Synthetic oligonucleotide
tggcttccatgaatgccagc

SEQ ID NO: 10634 - DNA, 20 bp, Artificial Sequence
  Description of Artificial Sequence: Synthetic oligonucleotide
ggcttccatgaatgccagct

SEQ ID NO: 10635 - DNA, 20 bp, Artificial Sequence
  Description of Artificial Sequence: Synthetic oligonucleotide
gcttccatgaatgccagctg

SEQ ID NO: 10636 - DNA, 20 bp, Artificial Sequence
  Description of Artificial Sequence: Synthetic oligonucleotide
cttccatgaatgccagctgt

SEQ ID NO: 10637 - DNA, 20 bp, Artificial Sequence
  Description of Artificial Sequence: Synthetic oligonucleotide
ttccatgaatgccagctgtt

SEQ ID NO: 10638 - DNA, 20 bp, Artificial Sequence
  Description of Artificial Sequence: Synthetic oligonucleotide
tccatgaatgccagctgttc

SEQ ID NO: 10639 - DNA, 20 bp, Artificial Sequence
  Description of Artificial Sequence: Synthetic oligonucleotide
ccatgaatgccagctgttcg

SEQ ID NO: 10640 - DNA, 20 bp, Artificial Sequence
  Description of Artificial Sequence: Synthetic oligonucleotide
catgaatgccagctgttcgc

SEQ ID NO: 10641 - DNA, 20 bp, Artificial Sequence
  Description of Artificial Sequence: Synthetic oligonucleotide
atgaatgccagctgttcgcc

SEQ ID NO: 10642 - DNA, 20 bp, Artificial Sequence
  Description of Artificial Sequence: Synthetic oligonucleotide
tgaatgccagctgttcgcct

SEQ ID NO: 10643 - DNA, 20 bp, Artificial Sequence
  Description of Artificial Sequence: Synthetic oligonucleotide
gaatgccagctgttcgcctt

SEQ ID NO: 10644 - DNA, 20 bp, Artificial Sequence
  Description of Artificial Sequence: Synthetic oligonucleotide
aatgccagctgttcgccttc

SEQ ID NO: 10645 - DNA, 20 bp, Artificial Sequence
  Description of Artificial Sequence: Synthetic oligonucleotide
atgccagctgttcgccttcc

SEQ ID NO: 10646 - DNA, 20 bp, Artificial Sequence
  Description of Artificial Sequence: Synthetic oligonucleotide
tgccagctgttcgccttccc

SEQ ID NO: 10647 - DNA, 20 bp, Artificial Sequence
  Description of Artificial Sequence: Synthetic oligonucleotide
gccagctgttcgccttccca

SEQ ID NO: 10648 - DNA, 20 bp, Artificial Sequence
  Description of Artificial Sequence: Synthetic oligonucleotide
ccagctgttcgccttcccag

SEQ ID NO: 10649 - DNA, 20 bp, Artificial Sequence
  Description of Artificial Sequence: Synthetic oligonucleotide
cagctgttcgccttcccagc

SEQ ID NO: 10650 - DNA, 20 bp, Artificial Sequence
  Description of Artificial Sequence: Synthetic oligonucleotide
agctgttcgccttcccagct

SEQ ID NO: 10651 - DNA, 20 bp, Artificial Sequence
  Description of Artificial Sequence: Synthetic oligonucleotide
gctgttcgccttcccagctc

SEQ ID NO: 10652 - DNA, 20 bp, Artificial Sequence
  Description of Artificial Sequence: Synthetic oligonucleotide
ctgttcgccttcccagctct

SEQ ID NO: 10653 - DNA, 20 bp, Artificial Sequence
  Description of Artificial Sequence: Synthetic oligonucleotide
tgttcgccttcccagctctg

SEQ ID NO: 10654 - DNA, 20 bp, Artificial Sequence
  Description of Artificial Sequence: Synthetic oligonucleotide
gttcgccttcccagctctga

SEQ ID NO: 10655 - DNA, 20 bp, Artificial Sequence
  Description of Artificial Sequence: Synthetic oligonucleotide
ttcgccttcccagctctgaa

SEQ ID NO: 10656 - DNA, 20 bp, Artificial Sequence
  Description of Artificial Sequence: Synthetic oligonucleotide
tcgccttcccagctctgaac

SEQ ID NO: 10657 - DNA, 20 bp, Artificial Sequence
  Description of Artificial Sequence: Synthetic oligonucleotide
cgccttcccagctctgaact

SEQ ID NO: 10658 - DNA, 20 bp, Artificial Sequence
  Description of Artificial Sequence: Synthetic oligonucleotide
gccttcccagctctgaactt

SEQ ID NO: 10659 - DNA, 20 bp, Artificial Sequence
  Description of Artificial Sequence: Synthetic oligonucleotide
ccttcccagctctgaacttt

SEQ ID NO: 10660 - DNA, 20 bp, Artificial Sequence
  Description of Artificial Sequence: Synthetic oligonucleotide
cttcccagctctgaactttc

SEQ ID NO: 10661 - DNA, 20 bp, Artificial Sequence
  Description of Artificial Sequence: Synthetic oligonucleotide
ttcccagctctgaactttct

SEQ ID NO: 10662 - DNA, 20 bp, Artificial Sequence
  Description of Artificial Sequence: Synthetic oligonucleotide
tcccagctctgaactttctc

SEQ ID NO: 10663 - DNA, 20 bp, Artificial Sequence
  Description of Artificial Sequence: Synthetic oligonucleotide
cccagctctgaactttctcc

SEQ ID NO: 10664 - DNA, 20 bp, Artificial Sequence
  Description of Artificial Sequence: Synthetic oligonucleotide
ccagctctgaactttctcct

SEQ ID NO: 10665 - DNA, 20 bp, Artificial Sequence
  Description of Artificial Sequence: Synthetic oligonucleotide
cagctctgaactttctccta

SEQ ID NO: 10666 - DNA, 20 bp, Artificial Sequence
  Description of Artificial Sequence: Synthetic oligonucleotide
agctctgaactttctcctac

SEQ ID NO: 10667 - DNA, 20 bp, Artificial Sequence
  Description of Artificial Sequence: Synthetic oligonucleotide
gctctgaactttctcctact

SEQ ID NO: 10668 - DNA, 20 bp, Artificial Sequence
  Description of Artificial Sequence: Synthetic oligonucleotide
ctctgaactttctcctactt

SEQ ID NO: 10669 - DNA, 20 bp, Artificial Sequence
  Description of Artificial Sequence: Synthetic oligonucleotide
tctgaactttctcctacttg

SEQ ID NO: 10670 - DNA, 20 bp, Artificial Sequence
  Description of Artificial Sequence: Synthetic oligonucleotide
ctgaactttctcctacttgg

SEQ ID NO: 10671 - DNA, 20 bp, Artificial Sequence
  Description of Artificial Sequence: Synthetic oligonucleotide
tgaactttctcctacttggc

SEQ ID NO: 10672 - DNA, 20 bp, Artificial Sequence
  Description of Artificial Sequence: Synthetic oligonucleotide
gaactttctcctacttggcg

SEQ ID NO: 10673 - DNA, 20 bp, Artificial Sequence
  Description of Artificial Sequence: Synthetic oligonucleotide
aactttctcctacttggcgg

SEQ ID NO: 10674 - DNA, 20 bp, Artificial Sequence
  Description of Artificial Sequence: Synthetic oligonucleotide
actttctcctacttggcggg

SEQ ID NO: 10675 - DNA, 20 bp, Artificial Sequence
  Description of Artificial Sequence: Synthetic oligonucleotide
ctttctcctacttggcgggc

SEQ ID NO: 10676 - DNA, 20 bp, Artificial Sequence
  Description of Artificial Sequence: Synthetic oligonucleotide
tttctcctacttggcgggcc

SEQ ID NO: 10677 - DNA, 20 bp, Artificial Sequence
  Description of Artificial Sequence: Synthetic oligonucleotide
ttctcctacttggcgggcct

SEQ ID NO: 10678 - DNA, 20 bp, Artificial Sequence
  Description of Artificial Sequence: Synthetic oligonucleotide
tctcctacttggcgggcctg

SEQ ID NO: 10679 - DNA, 20 bp, Artificial Sequence
  Description of Artificial Sequence: Synthetic oligonucleotide
ctcctacttggcgggcctga

SEQ ID NO: 10680 - DNA, 20 bp, Artificial Sequence
  Description of Artificial Sequence: Synthetic oligonucleotide
tcctacttggcgggcctgag

SEQ ID NO: 10681 - DNA, 20 bp, Artificial Sequence
  Description of Artificial Sequence: Synthetic oligonucleotide
cctacttggcgggcctgagc

SEQ ID NO: 10682 - DNA, 20 bp, Artificial Sequence
  Description of Artificial Sequence: Synthetic oligonucleotide
ctacttggcgggcctgagcc

SEQ ID NO: 10683 - DNA, 20 bp, Artificial Sequence
  Description of Artificial Sequence: Synthetic oligonucleotide
tacttggcgggcctgagcca

SEQ ID NO: 10684 - DNA, 20 bp, Artificial Sequence
  Description of Artificial Sequence: Synthetic oligonucleotide
acttggcgggcctgagccaa

SEQ ID NO: 10685 - DNA, 20 bp, Artificial Sequence
  Description of Artificial Sequence: Synthetic oligonucleotide
cttggcgggcctgagccaag

SEQ ID NO: 10686 - DNA, 20 bp, Artificial Sequence
  Description of Artificial Sequence: Synthetic oligonucleotide
ttggcgggcctgagccaaga

SEQ ID NO: 10687 - DNA, 20 bp, Artificial Sequence
  Description of Artificial Sequence: Synthetic oligonucleotide
tggcgggcctgagccaagag

SEQ ID NO: 10688 - DNA, 20 bp, Artificial Sequence
  Description of Artificial Sequence: Synthetic oligonucleotide
ggcgggcctgagccaagagt

SEQ ID NO: 10689 - DNA, 20 bp, Artificial Sequence
  Description of Artificial Sequence: Synthetic oligonucleotide
gcgggcctgagccaagagtc

SEQ ID NO: 10690 - DNA, 20 bp, Artificial Sequence
  Description of Artificial Sequence: Synthetic oligonucleotide
cgggcctgagccaagagtct

SEQ ID NO: 10691 - DNA, 20 bp, Artificial Sequence
  Description of Artificial Sequence: Synthetic oligonucleotide
gggcctgagccaagagtctg

SEQ ID NO: 10692 - DNA, 20 bp, Artificial Sequence
  Description of Artificial Sequence: Synthetic oligonucleotide
ggcctgagccaagagtctgg

SEQ ID NO: 10693 - DNA, 20 bp, Artificial Sequence
  Description of Artificial Sequence: Synthetic oligonucleotide
gcctgagccaagagtctggg

SEQ ID NO: 10694 - DNA, 20 bp, Artificial Sequence
  Description of Artificial Sequence: Synthetic oligonucleotide
cctgagccaagagtctggga

SEQ ID NO: 10695 - DNA, 20 bp, Artificial Sequence
  Description of Artificial Sequence: Synthetic oligonucleotide
ctgagccaagagtctgggag

SEQ ID NO: 10696 - DNA, 20 bp, Artificial Sequence
  Description of Artificial Sequence: Synthetic oligonucleotide
tgagccaagagtctgggagt

SEQ ID NO: 10697 - DNA, 20 bp, Artificial Sequence
  Description of Artificial Sequence: Synthetic oligonucleotide
gagccaagagtctgggagtc

SEQ ID NO: 10698 - DNA, 20 bp, Artificial Sequence
  Description of Artificial Sequence: Synthetic oligonucleotide
agccaagagtctgggagtcc

SEQ ID NO: 10699 - DNA, 20 bp, Artificial Sequence
  Description of Artificial Sequence: Synthetic oligonucleotide
gccaagagtctgggagtccc

SEQ ID NO: 10700 - DNA, 20 bp, Artificial Sequence
  Description of Artificial Sequence: Synthetic oligonucleotide
ccaagagtctgggagtcccg

SEQ ID NO: 10701 - DNA, 20 bp, Artificial Sequence
  Description of Artificial Sequence: Synthetic oligonucleotide
caagagtctgggagtcccga

SEQ ID NO: 10702 - DNA, 20 bp, Artificial Sequence
  Description of Artificial Sequence: Synthetic oligonucleotide
aagagtctgggagtcccgaa

SEQ ID NO: 10703 - DNA, 20 bp, Artificial Sequence
  Description of Artificial Sequence: Synthetic oligonucleotide
agagtctgggagtcccgaac

SEQ ID NO: 10704 - DNA, 20 bp, Artificial Sequence
  Description of Artificial Sequence: Synthetic oligonucleotide
gagtctgggagtcccgaacc

SEQ ID NO: 10705 - DNA, 20 bp, Artificial Sequence
  Description of Artificial Sequence: Synthetic oligonucleotide
agtctgggagtcccgaaccc

SEQ ID NO: 10706 - DNA, 20 bp, Artificial Sequence
  Description of Artificial Sequence: Synthetic oligonucleotide
gtctgggagtcccgaaccca

SEQ ID NO: 10707 - DNA, 20 bp, Artificial Sequence
  Description of Artificial Sequence: Synthetic oligonucleotide
tctgggagtcccgaacccac

SEQ ID NO: 10708 - DNA, 20 bp, Artificial Sequence
  Description of Artificial Sequence: Synthetic oligonucleotide
ctgggagtcccgaacccaca

SEQ ID NO: 10709 - DNA, 20 bp, Artificial Sequence
  Description of Artificial Sequence: Synthetic oligonucleotide
tgggagtcccgaacccacag

SEQ ID NO: 10710 - DNA, 20 bp, Artificial Sequence
  Description of Artificial Sequence: Synthetic oligonucleotide
gggagtcccgaacccacaga

SEQ ID NO: 10711 - DNA, 20 bp, Artificial Sequence
  Description of Artificial Sequence: Synthetic oligonucleotide
ggagtcccgaacccacagaa

SEQ ID NO: 10712 - DNA, 20 bp, Artificial Sequence
  Description of Artificial Sequence: Synthetic oligonucleotide
gagtcccgaacccacagaac

SEQ ID NO: 10713 - DNA, 20 bp, Artificial Sequence
  Description of Artificial Sequence: Synthetic oligonucleotide
agtcccgaacccacagaacc

SEQ ID NO: 10714 - DNA, 20 bp, Artificial Sequence
  Description of Artificial Sequence: Synthetic oligonucleotide
gtcccgaacccacagaaccc

SEQ ID NO: 10715 - DNA, 20 bp, Artificial Sequence
  Description of Artificial Sequence: Synthetic oligonucleotide
tcccgaacccacagaacccc

SEQ ID NO: 10716 - DNA, 20 bp, Artificial Sequence
  Description of Artificial Sequence: Synthetic oligonucleotide
cccgaacccacagaacccct

SEQ ID NO: 10717 - DNA, 20 bp, Artificial Sequence
  Description of Artificial Sequence: Synthetic oligonucleotide
ccgaacccacagaacccctg

SEQ ID NO: 10718 - DNA, 20 bp, Artificial Sequence
  Description of Artificial Sequence: Synthetic oligonucleotide
cgaacccacagaacccctgc

SEQ ID NO: 10719 - DNA, 20 bp, Artificial Sequence
  Description of Artificial Sequence: Synthetic oligonucleotide
gaacccacagaacccctgcc

SEQ ID NO: 10720 - DNA, 20 bp, Artificial Sequence
  Description of Artificial Sequence: Synthetic oligonucleotide
aacccacagaacccctgccc

SEQ ID NO: 10721 - DNA, 20 bp, Artificial Sequence
  Description of Artificial Sequence: Synthetic oligonucleotide
acccacagaacccctgcccc

SEQ ID NO: 10722 - DNA, 20 bp, Artificial Sequence
  Description of Artificial Sequence: Synthetic oligonucleotide
cccacagaacccctgccccc

SEQ ID NO: 10723 - DNA, 20 bp, Artificial Sequence
  Description of Artificial Sequence: Synthetic oligonucleotide
ccacagaacccctgccccct

SEQ ID NO: 10724 - DNA, 20 bp, Artificial Sequence
  Description of Artificial Sequence: Synthetic oligonucleotide
cacagaacccctgccccctt

SEQ ID NO: 10725 - DNA, 20 bp, Artificial Sequence
  Description of Artificial Sequence: Synthetic oligonucleotide
acagaacccctgcccccttc

SEQ ID NO: 10726 - DNA, 20 bp, Artificial Sequence
  Description of Artificial Sequence: Synthetic oligonucleotide
cagaacccctgcccccttcc

SEQ ID NO: 10727 - DNA, 20 bp, Artificial Sequence
  Description of Artificial Sequence: Synthetic oligonucleotide
agaacccctgcccccttcca

SEQ ID NO: 10728 - DNA, 20 bp, Artificial Sequence
  Description of Artificial Sequence: Synthetic oligonucleotide
gaacccctgcccccttccac

SEQ ID NO: 10729 - DNA, 20 bp, Artificial Sequence
  Description of Artificial Sequence: Synthetic oligonucleotide
aacccctgcccccttccacc

SEQ ID NO: 10730 - DNA, 20 bp, Artificial Sequence
  Description of Artificial Sequence: Synthetic oligonucleotide
acccctgcccccttccaccg

SEQ ID NO: 10731 - DNA, 20 bp, Artificial Sequence
  Description of Artificial Sequence: Synthetic oligonucleotide
cccctgcccccttccaccgc

SEQ ID NO: 10732 - DNA, 20 bp, Artificial Sequence
  Description of Artificial Sequence: Synthetic oligonucleotide
ccctgcccccttccaccgca

SEQ ID NO: 10733 - DNA, 20 bp, Artificial Sequence
  Description of Artificial Sequence: Synthetic oligonucleotide
cctgcccccttccaccgcat

SEQ ID NO: 10734 - DNA, 20 bp, Artificial Sequence
  Description of Artificial Sequence: Synthetic oligonucleotide
ctgcccccttccaccgcatt

SEQ ID NO: 10735 - DNA, 20 bp, Artificial Sequence
  Description of Artificial Sequence: Synthetic oligonucleotide
tgcccccttccaccgcattt

SEQ ID NO: 10736 - DNA, 20 bp, Artificial Sequence
  Description of Artificial Sequence: Synthetic oligonucleotide
gcccccttccaccgcatttc

SEQ ID NO: 10737 - DNA, 20 bp, Artificial Sequence
  Description of Artificial Sequence: Synthetic oligonucleotide
cccccttccaccgcatttcc

SEQ ID NO: 10738 - DNA, 20 bp, Artificial Sequence
  Description of Artificial Sequence: Synthetic oligonucleotide
ccccttccaccgcatttccc

SEQ ID NO: 10739 - DNA, 20 bp, Artificial Sequence
  Description of Artificial Sequence: Synthetic oligonucleotide
cccttccaccgcatttccca

SEQ ID NO: 10740 - DNA, 20 bp, Artificial Sequence
  Description of Artificial Sequence: Synthetic oligonucleotide
ccttccaccgcatttcccag

SEQ ID NO: 10741 - DNA, 20 bp, Artificial Sequence
  Description of Artificial Sequence: Synthetic oligonucleotide
cttccaccgcatttcccagc

SEQ ID NO: 10742 - DNA, 20 bp, Artificial Sequence
  Description of Artificial Sequence: Synthetic oligonucleotide
ttccaccgcatttcccagcc

SEQ ID NO: 10743 - DNA, 20 bp, Artificial Sequence
  Description of Artificial Sequence: Synthetic oligonucleotide
tccaccgcatttcccagcca

SEQ ID NO: 10744 - DNA, 20 bp, Artificial Sequence
  Description of Artificial Sequence: Synthetic oligonucleotide
ccaccgcatttcccagccag

SEQ ID NO: 10745 - DNA, 20 bp, Artificial Sequence
  Description of Artificial Sequence: Synthetic oligonucleotide
caccgcatttcccagccagg

SEQ ID NO: 10746 - DNA, 20 bp, Artificial Sequence
  Description of Artificial Sequence: Synthetic oligonucleotide
accgcatttcccagccagga

SEQ ID NO: 10747 - DNA, 20 bp, Artificial Sequence
  Description of Artificial Sequence: Synthetic oligonucleotide
ccgcatttcccagccaggac

SEQ ID NO: 10748 - DNA, 20 bp, Artificial Sequence
  Description of Artificial Sequence: Synthetic oligonucleotide
cgcatttcccagccaggact

SEQ ID NO: 10749 - DNA, 20 bp, Artificial Sequence
  Description of Artificial Sequence: Synthetic oligonucleotide
gcatttcccagccaggactt

SEQ ID NO: 10750 - DNA, 20 bp, Artificial Sequence
  Description of Artificial Sequence: Synthetic oligonucleotide
catttcccagccaggacttg

SEQ ID NO: 10751 - DNA, 20 bp, Artificial Sequence
  Description of Artificial Sequence: Synthetic oligonucleotide
atttcccagccaggacttgt

SEQ ID NO: 10752 - DNA, 20 bp, Artificial Sequence
  Description of Artificial Sequence: Synthetic oligonucleotide
tttcccagccaggacttgtg

SEQ ID NO: 10753 - DNA, 20 bp, Artificial Sequence
  Description of Artificial Sequence: Synthetic oligonucleotide
ttcccagccaggacttgtgc

SEQ ID NO: 10754 - DNA, 20 bp, Artificial Sequence
  Description of Artificial Sequence: Synthetic oligonucleotide
tcccagccaggacttgtgcc

SEQ ID NO: 10755 - DNA, 20 bp, Artificial Sequence
  Description of Artificial Sequence: Synthetic oligonucleotide
cccagccaggacttgtgcct

SEQ ID NO: 10756 - DNA, 20 bp, Artificial Sequence
  Description of Artificial Sequence: Synthetic oligonucleotide
ccagccaggacttgtgcctt

SEQ ID NO: 10757 - DNA, 20 bp, Artificial Sequence
  Description of Artificial Sequence: Synthetic oligonucleotide
cagccaggacttgtgccttc

SEQ ID NO: 10758 - DNA, 20 bp, Artificial Sequence
  Description of Artificial Sequence: Synthetic oligonucleotide
agccaggacttgtgccttcc

SEQ ID NO: 10759 - DNA, 20 bp, Artificial Sequence
  Description of Artificial Sequence: Synthetic oligonucleotide
gccaggacttgtgccttccc

SEQ ID NO: 10760 - DNA, 20 bp, Artificial Sequence
  Description of Artificial Sequence: Synthetic oligonucleotide
ccaggacttgtgccttcccc

SEQ ID NO: 10761 - DNA, 20 bp, Artificial Sequence
  Description of Artificial Sequence: Synthetic oligonucleotide
caggacttgtgccttccccc

SEQ ID NO: 10762 - DNA, 20 bp, Artificial Sequence
  Description of Artificial Sequence: Synthetic oligonucleotide
aggacttgtgccttcccccg

SEQ ID NO: 10763 - DNA, 20 bp, Artificial Sequence
  Description of Artificial Sequence: Synthetic oligonucleotide
ggacttgtgccttcccccgt

SEQ ID NO: 10764 - DNA, 20 bp, Artificial Sequence
  Description of Artificial Sequence: Synthetic oligonucleotide
gacttgtgccttcccccgtc

SEQ ID NO: 10765 - DNA, 20 bp, Artificial Sequence
  Description of Artificial Sequence: Synthetic oligonucleotide
acttgtgccttcccccgtca

SEQ ID NO: 10766 - DNA, 20 bp, Artificial Sequence
  Description of Artificial Sequence: Synthetic oligonucleotide
cttgtgccttcccccgtcac

SEQ ID NO: 10767 - DNA, 20 bp, Artificial Sequence
  Description of Artificial Sequence: Synthetic oligonucleotide
ttgtgccttcccccgtcacc

SEQ ID NO: 10768 - DNA, 20 bp, Artificial Sequence
  Description of Artificial Sequence: Synthetic oligonucleotide
tgtgccttcccccgtcaccc

SEQ ID NO: 10769 - DNA, 20 bp, Artificial Sequence
  Description of Artificial Sequence: Synthetic oligonucleotide
gtgccttcccccgtcaccct

SEQ ID NO: 10770 - DNA, 20 bp, Artificial Sequence
  Description of Artificial Sequence: Synthetic oligonucleotide
tgccttcccccgtcaccctc

SEQ ID NO: 10771 - DNA, 20 bp, Artificial Sequence
  Description of Artificial Sequence: Synthetic oligonucleotide
gccttcccccgtcaccctcc

SEQ ID NO: 10772 - DNA, 20 bp, Artificial Sequence
  Description of Artificial Sequence: Synthetic oligonucleotide
ccttcccccgtcaccctcca

SEQ ID NO: 10773 - DNA, 20 bp, Artificial Sequence
  Description of Artificial Sequence: Synthetic oligonucleotide
cttcccccgtcaccctccag

SEQ ID NO: 10774 - DNA, 20 bp, Artificial Sequence
  Description of Artificial Sequence: Synthetic oligonucleotide
ttcccccgtcaccctccaga

SEQ ID NO: 10775 - DNA, 20 bp, Artificial Sequence
  Description of Artificial Sequence: Synthetic oligonucleotide
tcccccgtcaccctccagaa

SEQ ID NO: 10776 - DNA, 20 bp, Artificial Sequence
  Description of Artificial Sequence: Synthetic oligonucleotide
cccccgtcaccctccagaag

SEQ ID NO: 10777 - DNA, 20 bp, Artificial Sequence
  Description of Artificial Sequence: Synthetic oligonucleotide
ccccgtcaccctccagaagc

SEQ ID NO: 10778 - DNA, 20 bp, Artificial Sequence
  Description of Artificial Sequence: Synthetic oligonucleotide
cccgtcaccctccagaagcc

SEQ ID NO: 10779 - DNA, 20 bp, Artificial Sequence
  Description of Artificial Sequence: Synthetic oligonucleotide
ccgtcaccctccagaagccc

SEQ ID NO: 10780 - DNA, 20 bp, Artificial Sequence
  Description of Artificial Sequence: Synthetic oligonucleotide
cgtcaccctccagaagcccc

SEQ ID NO: 10781 - DNA, 20 bp, Artificial Sequence
  Description of Artificial Sequence: Synthetic oligonucleotide
gtcaccctccagaagcccct

SEQ ID NO: 10782 - DNA, 20 bp, Artificial Sequence
  Description of Artificial Sequence: Synthetic oligonucleotide
tcaccctccagaagcccctc

SEQ ID NO: 10783 - DNA, 20 bp, Artificial Sequence
  Description of Artificial Sequence: Synthetic oligonucleotide
caccctccagaagcccctca

SEQ ID NO: 10784 - DNA, 20 bp, Artificial Sequence
  Description of Artificial Sequence: Synthetic oligonucleotide
accctccagaagcccctcat

SEQ ID NO: 10785 - DNA, 20 bp, Artificial Sequence
  Description of Artificial Sequence: Synthetic oligonucleotide
ccctccagaagcccctcatc

SEQ ID NO: 10786 - DNA, 20 bp, Artificial Sequence
  Description of Artificial Sequence: Synthetic oligonucleotide
cctccagaagcccctcatcc

SEQ ID NO: 10787 - DNA, 20 bp, Artificial Sequence
  Description of Artificial Sequence: Synthetic oligonucleotide
ctccagaagcccctcatcct

SEQ ID NO: 10788 - DNA, 20 bp, Artificial Sequence
  Description of Artificial Sequence: Synthetic oligonucleotide
tccagaagcccctcatcctg

SEQ ID NO: 10789 - DNA, 20 bp, Artificial Sequence
  Description of Artificial Sequence: Synthetic oligonucleotide
ccagaagcccctcatcctgg

SEQ ID NO: 10790 - DNA, 20 bp, Artificial Sequence
  Description of Artificial Sequence: Synthetic oligonucleotide
cagaagcccctcatcctggg

SEQ ID NO: 10791 - DNA, 20 bp, Artificial Sequence
  Description of Artificial Sequence: Synthetic oligonucleotide
agaagcccctcatcctggga

SEQ ID NO: 10792 - DNA, 20 bp, Artificial Sequence
  Description of Artificial Sequence: Synthetic oligonucleotide
gaagcccctcatcctgggat

SEQ ID NO: 10793 - DNA, 20 bp, Artificial Sequence
  Description of Artificial Sequence: Synthetic oligonucleotide
aagcccctcatcctgggatg

SEQ ID NO: 10794 - DNA, 20 bp, Artificial Sequence
  Description of Artificial Sequence: Synthetic oligonucleotide
agcccctcatcctgggatgg

SEQ ID NO: 10795 - DNA, 20 bp, Artificial Sequence
  Description of Artificial Sequence: Synthetic oligonucleotide
gcccctcatcctgggatggt

SEQ ID NO: 10796 - DNA, 20 bp, Artificial Sequence
  Description of Artificial Sequence: Synthetic oligonucleotide
cccctcatcctgggatggtg

SEQ ID NO: 10797 - DNA, 20 bp, Artificial Sequence
  Description of Artificial Sequence: Synthetic oligonucleotide
ccctcatcctgggatggtgg

SEQ ID NO: 10798 - DNA, 20 bp, Artificial Sequence
  Description of Artificial Sequence: Synthetic oligonucleotide
cctcatcctgggatggtggc

SEQ ID NO: 10799 - DNA, 20 bp, Artificial Sequence
  Description of Artificial Sequence: Synthetic oligonucleotide
ctcatcctgggatggtggct

SEQ ID NO: 10800 - DNA, 20 bp, Artificial Sequence
  Description of Artificial Sequence: Synthetic oligonucleotide
tcatcctgggatggtggctt

SEQ ID NO: 10801 - DNA, 20 bp, Artificial Sequence
  Description of Artificial Sequence: Synthetic oligonucleotide
catcctgggatggtggcttt

SEQ ID NO: 10802 - DNA, 20 bp, Artificial Sequence
  Description of Artificial Sequence: Synthetic oligonucleotide
atcctgggatggtggctttg

SEQ ID NO: 10803 - DNA, 20 bp, Artificial Sequence
  Description of Artificial Sequence: Synthetic oligonucleotide
tcctgggatggtggctttgg

SEQ ID NO: 10804 - DNA, 20 bp, Artificial Sequence
  Description of Artificial Sequence: Synthetic oligonucleotide
cctgggatggtggctttggg

SEQ ID NO: 10805 - DNA, 20 bp, Artificial Sequence
  Description of Artificial Sequence: Synthetic oligonucleotide
ctgggatggtggctttggga

SEQ ID NO: 10806 - DNA, 20 bp, Artificial Sequence
  Description of Artificial Sequence: Synthetic oligonucleotide
tgggatggtggctttgggag

SEQ ID NO: 10807 - DNA, 20 bp, Artificial Sequence
  Description of Artificial Sequence: Synthetic oligonucleotide
gggatggtggctttgggagg

SEQ ID NO: 10808 - DNA, 20 bp, Artificial Sequence
  Description of Artificial Sequence: Synthetic oligonucleotide
ggatggtggctttgggaggg

SEQ ID NO: 10809 - DNA, 20 bp, Artificial Sequence
  Description of Artificial Sequence: Synthetic oligonucleotide
gatggtggctttgggagggt

SEQ ID NO: 10810 - DNA, 20 bp, Artificial Sequence
  Description of Artificial Sequence: Synthetic oligonucleotide
atggtggctttgggagggtg

SEQ ID NO: 10811 - DNA, 20 bp, Artificial Sequence
  Description of Artificial Sequence: Synthetic oligonucleotide
tggtggctttgggagggtgg

SEQ ID NO: 10812 - DNA, 20 bp, Artificial Sequence
  Description of Artificial Sequence: Synthetic oligonucleotide
ggtggctttgggagggtgga

SEQ ID NO: 10813 - DNA, 20 bp, Artificial Sequence
  Description of Artificial Sequence: Synthetic oligonucleotide
gtggctttgggagggtggac

SEQ ID NO: 10814 - DNA, 20 bp, Artificial Sequence
  Description of Artificial Sequence: Synthetic oligonucleotide
tggctttgggagggtggaca

SEQ ID NO: 10815 - DNA, 20 bp, Artificial Sequence
  Description of Artificial Sequence: Synthetic oligonucleotide
ggctttgggagggtggacag

SEQ ID NO: 10816 - DNA, 20 bp, Artificial Sequence
  Description of Artificial Sequence: Synthetic oligonucleotide
gctttgggagggtggacagg

SEQ ID NO: 10817 - DNA, 20 bp, Artificial Sequence
  Description of Artificial Sequence: Synthetic oligonucleotide
ctttgggagggtggacagga

SEQ ID NO: 10818 - DNA, 20 bp, Artificial Sequence
  Description of Artificial Sequence: Synthetic oligonucleotide
tttgggagggtggacaggac

SEQ ID NO: 10819 - DNA, 20 bp, Artificial Sequence
  Description of Artificial Sequence: Synthetic oligonucleotide
ttgggagggtggacaggacc

SEQ ID NO: 10820 - DNA, 20 bp, Artificial Sequence
  Description of Artificial Sequence: Synthetic oligonucleotide
tgggagggtggacaggaccc

SEQ ID NO: 10821 - DNA, 20 bp, Artificial Sequence
  Description of Artificial Sequence: Synthetic oligonucleotide
gggagggtggacaggaccct

SEQ ID NO: 10822 - DNA, 20 bp, Artificial Sequence
  Description of Artificial Sequence: Synthetic oligonucleotide
ggagggtggacaggaccctg

SEQ ID NO: 10823 - DNA, 20 bp, Artificial Sequence
  Description of Artificial Sequence: Synthetic oligonucleotide
gagggtggacaggaccctga

SEQ ID NO: 10824 - DNA, 20 bp, Artificial Sequence
  Description of Artificial Sequence: Synthetic oligonucleotide
agggtggacaggaccctgac

SEQ ID NO: 10825 - DNA, 20 bp, Artificial Sequence
  Description of Artificial Sequence: Synthetic oligonucleotide
gggtggacaggaccctgacc

SEQ ID NO: 10826 - DNA, 20 bp, Artificial Sequence
  Description of Artificial Sequence: Synthetic oligonucleotide
ggtggacaggaccctgacca

SEQ ID NO: 10827 - DNA, 20 bp, Artificial Sequence
  Description of Artificial Sequence: Synthetic oligonucleotide
gtggacaggaccctgaccac

SEQ ID NO: 10828 - DNA, 20 bp, Artificial Sequence
  Description of Artificial Sequence: Synthetic oligonucleotide
tggacaggaccctgaccacg

SEQ ID NO: 10829 - DNA, 20 bp, Artificial Sequence
  Description of Artificial Sequence: Synthetic oligonucleotide
ggacaggaccctgaccacgc

SEQ ID NO: 10830 - DNA, 20 bp, Artificial Sequence
  Description of Artificial Sequence: Synthetic oligonucleotide
gacaggaccctgaccacgct

SEQ ID NO: 10831 - DNA, 20 bp, Artificial Sequence
  Description of Artificial Sequence: Synthetic oligonucleotide
acaggaccctgaccacgctg

SEQ ID NO: 10832 - DNA, 20 bp, Artificial Sequence
  Description of Artificial Sequence: Synthetic oligonucleotide
caggaccctgaccacgctga

SEQ ID NO: 10833 - DNA, 20 bp, Artificial Sequence
  Description of Artificial Sequence: Synthetic oligonucleotide
aggaccctgaccacgctgag

SEQ ID NO: 10834 - DNA, 20 bp, Artificial Sequence
  Description of Artificial Sequence: Synthetic oligonucleotide
ggaccctgaccacgctgaga

SEQ ID NO: 10835 - DNA, 20 bp, Artificial Sequence
  Description of Artificial Sequence: Synthetic oligonucleotide
gaccctgaccacgctgagat

SEQ ID NO: 10836 - DNA, 20 bp, Artificial Sequence
  Description of Artificial Sequence: Synthetic oligonucleotide
accctgaccacgctgagatg

SEQ ID NO: 10837 - DNA, 20 bp, Artificial Sequence
  Description of Artificial Sequence: Synthetic oligonucleotide
ccctgaccacgctgagatgc

SEQ ID NO: 10838 - DNA, 20 bp, Artificial Sequence
  Description of Artificial Sequence: Synthetic oligonucleotide
cctgaccacgctgagatgct

SEQ ID NO: 10839 - DNA, 20 bp, Artificial Sequence
  Description of Artificial Sequence: Synthetic oligonucleotide
ctgaccacgctgagatgcta

SEQ ID NO: 10840 - DNA, 20 bp, Artificial Sequence
  Description of Artificial Sequence: Synthetic oligonucleotide
tgaccacgctgagatgctag

SEQ ID NO: 10841 - DNA, 20 bp, Artificial Sequence
  Description of Artificial Sequence: Synthetic oligonucleotide
gaccacgctgagatgctagc

SEQ ID NO: 10842 - DNA, 20 bp, Artificial Sequence
  Description of Artificial Sequence: Synthetic oligonucleotide
accacgctgagatgctagcc

SEQ ID NO: 10843 - DNA, 20 bp, Artificial Sequence
  Description of Artificial Sequence: Synthetic oligonucleotide
ccacgctgagatgctagcct

SEQ ID NO: 10844 - DNA, 20 bp, Artificial Sequence
  Description of Artificial Sequence: Synthetic oligonucleotide
cacgctgagatgctagcctg

SEQ ID NO: 10845 - DNA, 20 bp, Artificial Sequence
  Description of Artificial Sequence: Synthetic oligonucleotide
acgctgagatgctagcctgg

SEQ ID NO: 10846 - DNA, 20 bp, Artificial Sequence
  Description of Artificial Sequence: Synthetic oligonucleotide
cgctgagatgctagcctggc

SEQ ID NO: 10847 - DNA, 20 bp, Artificial Sequence
  Description of Artificial Sequence: Synthetic oligonucleotide
gctgagatgctagcctggcg

SEQ ID NO: 10848 - DNA, 20 bp, Artificial Sequence
  Description of Artificial Sequence: Synthetic oligonucleotide
ctgagatgctagcctggcgg

SEQ ID NO: 10849 - DNA, 20 bp, Artificial Sequence
  Description of Artificial Sequence: Synthetic oligonucleotide
tgagatgctagcctggcggg

SEQ ID NO: 10850 - DNA, 20 bp, Artificial Sequence
  Description of Artificial Sequence: Synthetic oligonucleotide
gagatgctagcctggcgggg

SEQ ID NO: 10851 - DNA, 20 bp, Artificial Sequence
  Description of Artificial Sequence: Synthetic oligonucleotide
agatgctagcctggcggggt

SEQ ID NO: 10852 - DNA, 20 bp, Artificial Sequence
  Description of Artificial Sequence: Synthetic oligonucleotide
gatgctagcctggcggggtt

SEQ ID NO: 10853 - DNA, 20 bp, Artificial Sequence
  Description of Artificial Sequence: Synthetic oligonucleotide
atgctagcctggcggggttg

SEQ ID NO: 10854 - DNA, 20 bp, Artificial Sequence
  Description of Artificial Sequence: Synthetic oligonucleotide
tgctagcctggcggggttgg

SEQ ID NO: 10855 - DNA, 20 bp, Artificial Sequence
  Description of Artificial Sequence: Synthetic oligonucleotide
gctagcctggcggggttggg

SEQ ID NO: 10856 - DNA, 20 bp, Artificial Sequence
  Description of Artificial Sequence: Synthetic oligonucleotide
ctagcctggcggggttgggg

SEQ ID NO: 10857 - DNA, 20 bp, Artificial Sequence
  Description of Artificial Sequence: Synthetic oligonucleotide
tagcctggcggggttggggg

SEQ ID NO: 10858 - DNA, 20 bp, Artificial Sequence
  Description of Artificial Sequence: Synthetic oligonucleotide
agcctggcggggttgggggc

SEQ ID NO: 10859 - DNA, 20 bp, Artificial Sequence
  Description of Artificial Sequence: Synthetic oligonucleotide
gcctggcggggttgggggcg

SEQ ID NO: 10860 - DNA, 20 bp, Artificial Sequence
  Description of Artificial Sequence: Synthetic oligonucleotide
cctggcggggttgggggcgg

SEQ ID NO: 10861 - DNA, 20 bp, Artificial Sequence
  Description of Artificial Sequence: Synthetic oligonucleotide
ctggcggggttgggggcggg

SEQ ID NO: 10862 - DNA, 20 bp, Artificial Sequence
  Description of Artificial Sequence: Synthetic oligonucleotide
tggcggggttgggggcgggc

SEQ ID NO: 10863 - DNA, 20 bp, Artificial Sequence
  Description of Artificial Sequence: Synthetic oligonucleotide
ggcggggttgggggcgggca

SEQ ID NO: 10864 - DNA, 20 bp, Artificial Sequence
  Description of Artificial Sequence: Synthetic oligonucleotide
gcggggttgggggcgggcag

SEQ ID NO: 10865 - DNA, 20 bp, Artificial Sequence
  Description of Artificial Sequence: Synthetic oligonucleotide
cggggttgggggcgggcagc

SEQ ID NO: 10866 - DNA, 20 bp, Artificial Sequence
  Description of Artificial Sequence: Synthetic oligonucleotide
ggggttgggggcgggcagca

SEQ ID NO: 10867 - DNA, 20 bp, Artificial Sequence
  Description of Artificial Sequence: Synthetic oligonucleotide
gggttgggggcgggcagcac

SEQ ID NO: 10868 - DNA, 20 bp, Artificial Sequence
  Description of Artificial Sequence: Synthetic oligonucleotide
ggttgggggcgggcagcacg

SEQ ID NO: 10869 - DNA, 20 bp, Artificial Sequence
  Description of Artificial Sequence: Synthetic oligonucleotide
gttgggggcgggcagcacgg

SEQ ID NO: 10870 - DNA, 20 bp, Artificial Sequence
  Description of Artificial Sequence: Synthetic oligonucleotide
ttgggggcgggcagcacgga

SEQ ID NO: 10871 - DNA, 20 bp, Artificial Sequence
  Description of Artificial Sequence: Synthetic oligonucleotide
tgggggcgggcagcacggag

SEQ ID NO: 10872 - DNA, 20 bp, Artificial Sequence
  Description of Artificial Sequence: Synthetic oligonucleotide
gggggcgggcagcacggagg

SEQ ID NO: 10873 - DNA, 20 bp, Artificial Sequence
  Description of Artificial Sequence: Synthetic oligonucleotide
ggggcgggcagcacggaggt

SEQ ID NO: 10874 - DNA, 20 bp, Artificial Sequence
  Description of Artificial Sequence: Synthetic oligonucleotide
gggcgggcagcacggaggtg

SEQ ID NO: 10875 - DNA, 20 bp, Artificial Sequence
  Description of Artificial Sequence: Synthetic oligonucleotide
ggcgggcagcacggaggtgg

SEQ ID NO: 10876 - DNA, 20 bp, Artificial Sequence
  Description of Artificial Sequence: Synthetic oligonucleotide
gcgggcagcacggaggtggg

SEQ ID NO: 10877 - DNA, 20 bp, Artificial Sequence
  Description of Artificial Sequence: Synthetic oligonucleotide
cgggcagcacggaggtggga

SEQ ID NO: 10878 - DNA, 20 bp, Artificial Sequence
  Description of Artificial Sequence: Synthetic oligonucleotide
gggcagcacggaggtgggaa

SEQ ID NO: 10879 - DNA, 20 bp, Artificial Sequence
  Description of Artificial Sequence: Synthetic oligonucleotide
ggcagcacggaggtgggaag

SEQ ID NO: 10880 - DNA, 20 bp, Artificial Sequence
  Description of Artificial Sequence: Synthetic oligonucleotide
gcagcacggaggtgggaagg

SEQ ID NO: 10881 - DNA, 20 bp, Artificial Sequence
  Description of Artificial Sequence: Synthetic oligonucleotide
cagcacggaggtgggaagga

SEQ ID NO: 10882 - DNA, 20 bp, Artificial Sequence
  Description of Artificial Sequence: Synthetic oligonucleotide
agcacggaggtgggaaggag

SEQ ID NO: 10883 - DNA, 20 bp, Artificial Sequence
  Description of Artificial Sequence: Synthetic oligonucleotide
gcacggaggtgggaaggagc

SEQ ID NO: 10884 - DNA, 20 bp, Artificial Sequence
  Description of Artificial Sequence: Synthetic oligonucleotide
cacggaggtgggaaggagcg

SEQ ID NO: 10885 - DNA, 20 bp, Artificial Sequence
  Description of Artificial Sequence: Synthetic oligonucleotide
acggaggtgggaaggagcgg

SEQ ID NO: 10886 - DNA, 20 bp, Artificial Sequence
  Description of Artificial Sequence: Synthetic oligonucleotide
cggaggtgggaaggagcggg

SEQ ID NO: 10887 - DNA, 20 bp, Artificial Sequence
  Description of Artificial Sequence: Synthetic oligonucleotide
ggaggtgggaaggagcggga

SEQ ID NO: 10888 - DNA, 20 bp, Artificial Sequence
  Description of Artificial Sequence: Synthetic oligonucleotide
gaggtgggaaggagcgggag

SEQ ID NO: 10889 - DNA, 20 bp, Artificial Sequence
  Description of Artificial Sequence: Synthetic oligonucleotide
aggtgggaaggagcgggagc

SEQ ID NO: 10890 - DNA, 20 bp, Artificial Sequence
  Description of Artificial Sequence: Synthetic oligonucleotide
ggtgggaaggagcgggagct

SEQ ID NO: 10891 - DNA, 20 bp, Artificial Sequence
  Description of Artificial Sequence: Synthetic oligonucleotide
gtgggaaggagcgggagctt

SEQ ID NO: 10892 - DNA, 20 bp, Artificial Sequence
  Description of Artificial Sequence: Synthetic oligonucleotide
tgggaaggagcgggagcttg

SEQ ID NO: 10893 - DNA, 20 bp, Artificial Sequence
  Description of Artificial Sequence: Synthetic oligonucleotide
gggaaggagcgggagcttgg

SEQ ID NO: 10894 - DNA, 20 bp, Artificial Sequence
  Description of Artificial Sequence: Synthetic oligonucleotide
ggaaggagcgggagcttggg

SEQ ID NO: 10895 - DNA, 20 bp, Artificial Sequence
  Description of Artificial Sequence: Synthetic oligonucleotide
gaaggagcgggagcttgggg

SEQ ID NO: 10896 - DNA, 20 bp, Artificial Sequence
  Description of Artificial Sequence: Synthetic oligonucleotide
aaggagcgggagcttgggga

SEQ ID NO: 10897 - DNA, 20 bp, Artificial Sequence
  Description of Artificial Sequence: Synthetic oligonucleotide
aggagcgggagcttggggag

SEQ ID NO: 10898 - DNA, 20 bp, Artificial Sequence
  Description of Artificial Sequence: Synthetic oligonucleotide
ggagcgggagcttggggagg

SEQ ID NO: 10899 - DNA, 20 bp, Artificial Sequence
  Description of Artificial Sequence: Synthetic oligonucleotide
gagcgggagcttggggagga

SEQ ID NO: 10900 - DNA, 20 bp, Artificial Sequence
  Description of Artificial Sequence: Synthetic oligonucleotide
agcgggagcttggggaggag

SEQ ID NO: 10901 - DNA, 20 bp, Artificial Sequence
  Description of Artificial Sequence: Synthetic oligonucleotide
gcgggagcttggggaggaga

SEQ ID NO: 10902 - DNA, 20 bp, Artificial Sequence
  Description of Artificial Sequence: Synthetic oligonucleotide
cgggagcttggggaggagag

SEQ ID NO: 10903 - DNA, 20 bp, Artificial Sequence
  Description of Artificial Sequence: Synthetic oligonucleotide
gggagcttggggaggagaga

SEQ ID NO: 10904 - DNA, 20 bp, Artificial Sequence
  Description of Artificial Sequence: Synthetic oligonucleotide
ggagcttggggaggagagaa

SEQ ID NO: 10905 - DNA, 20 bp, Artificial Sequence
  Description of Artificial Sequence: Synthetic oligonucleotide
gagcttggggaggagagaac

SEQ ID NO: 10906 - DNA, 20 bp, Artificial Sequence
  Description of Artificial Sequence: Synthetic oligonucleotide
agcttggggaggagagaacc

SEQ ID NO: 10907 - DNA, 20 bp, Artificial Sequence
  Description of Artificial Sequence: Synthetic oligonucleotide
gcttggggaggagagaaccc

SEQ ID NO: 10908 - DNA, 20 bp, Artificial Sequence
  Description of Artificial Sequence: Synthetic oligonucleotide
cttggggaggagagaaccct

SEQ ID NO: 10909 - DNA, 20 bp, Artificial Sequence
  Description of Artificial Sequence: Synthetic oligonucleotide
ttggggaggagagaaccctc

SEQ ID NO: 10910 - DNA, 20 bp, Artificial Sequence
  Description of Artificial Sequence: Synthetic oligonucleotide
tggggaggagagaaccctca

SEQ ID NO: 10911 - DNA, 20 bp, Artificial Sequence
  Description of Artificial Sequence: Synthetic oligonucleotide
ggggaggagagaaccctcag

SEQ ID NO: 10912 - DNA, 20 bp, Artificial Sequence
  Description of Artificial Sequence: Synthetic oligonucleotide
gggaggagagaaccctcagg

SEQ ID NO: 10913 - DNA, 20 bp, Artificial Sequence
  Description of Artificial Sequence: Synthetic oligonucleotide
ggaggagagaaccctcaggt

SEQ ID NO: 10914 - DNA, 20 bp, Artificial Sequence
  Description of Artificial Sequence: Synthetic oligonucleotide
gaggagagaaccctcaggtc

SEQ ID NO: 10915 - DNA, 20 bp, Artificial Sequence
  Description of Artificial Sequence: Synthetic oligonucleotide
aggagagaaccctcaggtct

SEQ ID NO: 10916 - DNA, 20 bp, Artificial Sequence
  Description of Artificial Sequence: Synthetic oligonucleotide
ggagagaaccctcaggtcta

SEQ ID NO: 10917 - DNA, 20 bp, Artificial Sequence
  Description of Artificial Sequence: Synthetic oligonucleotide
gagagaaccctcaggtctac

SEQ ID NO: 10918 - DNA, 20 bp, Artificial Sequence
  Description of Artificial Sequence: Synthetic oligonucleotide
agagaaccctcaggtctaca

SEQ ID NO: 10919 - DNA, 20 bp, Artificial Sequence
  Description of Artificial Sequence: Synthetic oligonucleotide
gagaaccctcaggtctacag

SEQ ID NO: 10920 - DNA, 20 bp, Artificial Sequence
  Description of Artificial Sequence: Synthetic oligonucleotide
agaaccctcaggtctacagt

SEQ ID NO: 10921 - DNA, 20 bp, Artificial Sequence
  Description of Artificial Sequence: Synthetic oligonucleotide
gaaccctcaggtctacagtg

SEQ ID NO: 10922 - DNA, 20 bp, Artificial Sequence
  Description of Artificial Sequence: Synthetic oligonucleotide
aaccctcaggtctacagtgc

SEQ ID NO: 10923 - DNA, 20 bp, Artificial Sequence
  Description of Artificial Sequence: Synthetic oligonucleotide
accctcaggtctacagtgct

SEQ ID NO: 10924 - DNA, 20 bp, Artificial Sequence
  Description of Artificial Sequence: Synthetic oligonucleotide
ccctcaggtctacagtgctg

SEQ ID NO: 10925 - DNA, 20 bp, Artificial Sequence
  Description of Artificial Sequence: Synthetic oligonucleotide
cctcaggtctacagtgctgg

SEQ ID NO: 10926 - DNA, 20 bp, Artificial Sequence
  Description of Artificial Sequence: Synthetic oligonucleotide
ctcaggtctacagtgctgga

SEQ ID NO: 10927 - DNA, 20 bp, Artificial Sequence
  Description of Artificial Sequence: Synthetic oligonucleotide
tcaggtctacagtgctggaa

SEQ ID NO: 10928 - DNA, 20 bp, Artificial Sequence
  Description of Artificial Sequence: Synthetic oligonucleotide
caggtctacagtgctggaag

SEQ ID NO: 10929 - DNA, 20 bp, Artificial Sequence
  Description of Artificial Sequence: Synthetic oligonucleotide
aggtctacagtgctggaagc

SEQ ID NO: 10930 - DNA, 20 bp, Artificial Sequence
  Description of Artificial Sequence: Synthetic oligonucleotide
ggtctacagtgctggaagcc

SEQ ID NO: 10931 - DNA, 20 bp, Artificial Sequence
  Description of Artificial Sequence: Synthetic oligonucleotide
gtctacagtgctggaagcct

SEQ ID NO: 10932 - DNA, 20 bp, Artificial Sequence
  Description of Artificial Sequence: Synthetic oligonucleotide
tctacagtgctggaagcctg

SEQ ID NO: 10933 - DNA, 20 bp, Artificial Sequence
  Description of Artificial Sequence: Synthetic oligonucleotide
ctacagtgctggaagcctgc

SEQ ID NO: 10934 - DNA, 20 bp, Artificial Sequence
  Description of Artificial Sequence: Synthetic oligonucleotide
tacagtgctggaagcctgcc

SEQ ID NO: 10935 - DNA, 20 bp, Artificial Sequence
  Description of Artificial Sequence: Synthetic oligonucleotide
acagtgctggaagcctgcca

SEQ ID NO: 10936 - DNA, 20 bp, Artificial Sequence
  Description of Artificial Sequence: Synthetic oligonucleotide
cagtgctggaagcctgccac

SEQ ID NO: 10937 - DNA, 20 bp, Artificial Sequence
  Description of Artificial Sequence: Synthetic oligonucleotide
agtgctggaagcctgccact

SEQ ID NO: 10938 - DNA, 20 bp, Artificial Sequence
  Description of Artificial Sequence: Synthetic oligonucleotide
gtgctggaagcctgccactg

SEQ ID NO: 10939 - DNA, 20 bp, Artificial Sequence
  Description of Artificial Sequence: Synthetic oligonucleotide
tgctggaagcctgccactga

SEQ ID NO: 10940 - DNA, 20 bp, Artificial Sequence
  Description of Artificial Sequence: Synthetic oligonucleotide
gctggaagcctgccactgac

SEQ ID NO: 10941 - DNA, 20 bp, Artificial Sequence
  Description of Artificial Sequence: Synthetic oligonucleotide
ctggaagcctgccactgacc

SEQ ID NO: 10942 - DNA, 20 bp, Artificial Sequence
  Description of Artificial Sequence: Synthetic oligonucleotide
tggaagcctgccactgaccc

SEQ ID NO: 10943 - DNA, 20 bp, Artificial Sequence
  Description of Artificial Sequence: Synthetic oligonucleotide
ggaagcctgccactgaccct

SEQ ID NO: 10944 - DNA, 20 bp, Artificial Sequence
  Description of Artificial Sequence: Synthetic oligonucleotide
gaagcctgccactgacccta

SEQ ID NO: 10945 - DNA, 20 bp, Artificial Sequence
  Description of Artificial Sequence: Synthetic oligonucleotide
aagcctgccactgaccctag

SEQ ID NO: 10946 - DNA, 20 bp, Artificial Sequence
  Description of Artificial Sequence: Synthetic oligonucleotide
agcctgccactgaccctagg

SEQ ID NO: 10947 - DNA, 20 bp, Artificial Sequence
  Description of Artificial Sequence: Synthetic oligonucleotide
gcctgccactgaccctaggg

SEQ ID NO: 10948 - DNA, 20 bp, Artificial Sequence
  Description of Artificial Sequence: Synthetic oligonucleotide
cctgccactgaccctagggt

SEQ ID NO: 10949 - DNA, 20 bp, Artificial Sequence
  Description of Artificial Sequence: Synthetic oligonucleotide
ctgccactgaccctagggtg

SEQ ID NO: 10950 - DNA, 20 bp, Artificial Sequence
  Description of Artificial Sequence: Synthetic oligonucleotide
tgccactgaccctagggtgt

SEQ ID NO: 10951 - DNA, 20 bp, Artificial Sequence
  Description of Artificial Sequence: Synthetic oligonucleotide
gccactgaccctagggtgtg

SEQ ID NO: 10952 - DNA, 20 bp, Artificial Sequence
  Description of Artificial Sequence: Synthetic oligonucleotide
ccactgaccctagggtgtga

SEQ ID NO: 10953 - DNA, 20 bp, Artificial Sequence
  Description of Artificial Sequence: Synthetic oligonucleotide
cactgaccctagggtgtgag

SEQ ID NO: 10954 - DNA, 20 bp, Artificial Sequence
  Description of Artificial Sequence: Synthetic oligonucleotide
actgaccctagggtgtgaga

SEQ ID NO: 10955 - DNA, 20 bp, Artificial Sequence
  Description of Artificial Sequence: Synthetic oligonucleotide
ctgaccctagggtgtgagag

SEQ ID NO: 10956 - DNA, 20 bp, Artificial Sequence
  Description of Artificial Sequence: Synthetic oligonucleotide
tgaccctagggtgtgagagg

SEQ ID NO: 10957 - DNA, 20 bp, Artificial Sequence
  Description of Artificial Sequence: Synthetic oligonucleotide
gaccctagggtgtgagaggg

SEQ ID NO: 10958 - DNA, 20 bp, Artificial Sequence
  Description of Artificial Sequence: Synthetic oligonucleotide
accctagggtgtgagagggg

SEQ ID NO: 10959 - DNA, 20 bp, Artificial Sequence
  Description of Artificial Sequence: Synthetic oligonucleotide
ccctagggtgtgagaggggg

SEQ ID NO: 10960 - DNA, 20 bp, Artificial Sequence
  Description of Artificial Sequence: Synthetic oligonucleotide
cctagggtgtgagaggggga

SEQ ID NO: 10961 - DNA, 20 bp, Artificial Sequence
  Description of Artificial Sequence: Synthetic oligonucleotide
ctagggtgtgagagggggat

SEQ ID NO: 10962 - DNA, 20 bp, Artificial Sequence
  Description of Artificial Sequence: Synthetic oligonucleotide
tagggtgtgagagggggatc

SEQ ID NO: 10963 - DNA, 20 bp, Artificial Sequence
  Description of Artificial Sequence: Synthetic oligonucleotide
agggtgtgagagggggatcc

SEQ ID NO: 10964 - DNA, 20 bp, Artificial Sequence
  Description of Artificial Sequence: Synthetic oligonucleotide
gggtgtgagagggggatcca

SEQ ID NO: 10965 - DNA, 20 bp, Artificial Sequence
  Description of Artificial Sequence: Synthetic oligonucleotide
ggtgtgagagggggatccaa

SEQ ID NO: 10966 - DNA, 20 bp, Artificial Sequence
  Description of Artificial Sequence: Synthetic oligonucleotide
gtgtgagagggggatccaaa

SEQ ID NO: 10967 - DNA, 20 bp, Artificial Sequence
  Description of Artificial Sequence: Synthetic oligonucleotide
tgtgagagggggatccaaac

SEQ ID NO: 10968 - DNA, 20 bp, Artificial Sequence
  Description of Artificial Sequence: Synthetic oligonucleotide
gtgagagggggatccaaact

SEQ ID NO: 10969 - DNA, 20 bp, Artificial Sequence
  Description of Artificial Sequence: Synthetic oligonucleotide
tgagagggggatccaaactt

SEQ ID NO: 10970 - DNA, 20 bp, Artificial Sequence
  Description of Artificial Sequence: Synthetic oligonucleotide
gagagggggatccaaacttt

SEQ ID NO: 10971 - DNA, 20 bp, Artificial Sequence
  Description of Artificial Sequence: Synthetic oligonucleotide
agagggggatccaaactttc

SEQ ID NO: 10972 - DNA, 20 bp, Artificial Sequence
  Description of Artificial Sequence: Synthetic oligonucleotide
gagggggatccaaactttca

SEQ ID NO: 10973 - DNA, 20 bp, Artificial Sequence
  Description of Artificial Sequence: Synthetic oligonucleotide
agggggatccaaactttcac

SEQ ID NO: 10974 - DNA, 20 bp, Artificial Sequence
  Description of Artificial Sequence: Synthetic oligonucleotide
gggggatccaaactttcacc

SEQ ID NO: 10975 - DNA, 20 bp, Artificial Sequence
  Description of Artificial Sequence: Synthetic oligonucleotide
ggggatccaaactttcaccc

SEQ ID NO: 10976 - DNA, 20 bp, Artificial Sequence
  Description of Artificial Sequence: Synthetic oligonucleotide
gggatccaaactttcaccca

SEQ ID NO: 10977 - DNA, 20 bp, Artificial Sequence
  Description of Artificial Sequence: Synthetic oligonucleotide
ggatccaaactttcacccag

SEQ ID NO: 10978 - DNA, 20 bp, Artificial Sequence
  Description of Artificial Sequence: Synthetic oligonucleotide
gatccaaactttcacccagt

SEQ ID NO: 10979 - DNA, 20 bp, Artificial Sequence
  Description of Artificial Sequence: Synthetic oligonucleotide
atccaaactttcacccagtt

SEQ ID NO: 10980 - DNA, 20 bp, Artificial Sequence
  Description of Artificial Sequence: Synthetic oligonucleotide
tccaaactttcacccagttg

SEQ ID NO: 10981 - DNA, 20 bp, Artificial Sequence
  Description of Artificial Sequence: Synthetic oligonucleotide
ccaaactttcacccagttgg

SEQ ID NO: 10982 - DNA, 20 bp, Artificial Sequence
  Description of Artificial Sequence: Synthetic oligonucleotide
caaactttcacccagttggc

SEQ ID NO: 10983 - DNA, 20 bp, Artificial Sequence
  Description of Artificial Sequence: Synthetic oligonucleotide
aaactttcacccagttggct

SEQ ID NO: 10984 - DNA, 20 bp, Artificial Sequence
  Description of Artificial Sequence: Synthetic oligonucleotide
aactttcacccagttggctg

SEQ ID NO: 10985 - DNA, 20 bp, Artificial Sequence
  Description of Artificial Sequence: Synthetic oligonucleotide
actttcacccagttggctgt

SEQ ID NO: 10986 - DNA, 20 bp, Artificial Sequence
  Description of Artificial Sequence: Synthetic oligonucleotide
ctttcacccagttggctgtg

SEQ ID NO: 10987 - DNA, 20 bp, Artificial Sequence
  Description of Artificial Sequence: Synthetic oligonucleotide
tttcacccagttggctgtgg

SEQ ID NO: 10988 - DNA, 20 bp, Artificial Sequence
  Description of Artificial Sequence: Synthetic oligonucleotide
ttcacccagttggctgtgga

SEQ ID NO: 10989 - DNA, 20 bp, Artificial Sequence
  Description of Artificial Sequence: Synthetic oligonucleotide
tcacccagttggctgtggac

SEQ ID NO: 10990 - DNA, 20 bp, Artificial Sequence
  Description of Artificial Sequence: Synthetic oligonucleotide
cacccagttggctgtggaca

SEQ ID NO: 10991 - DNA, 20 bp, Artificial Sequence
  Description of Artificial Sequence: Synthetic oligonucleotide
acccagttggctgtggacag

SEQ ID NO: 10992 - DNA, 20 bp, Artificial Sequence
  Description of Artificial Sequence: Synthetic oligonucleotide
cccagttggctgtggacagc

SEQ ID NO: 10993 - DNA, 20 bp, Artificial Sequence
  Description of Artificial Sequence: Synthetic oligonucleotide
ccagttggctgtggacagcc

SEQ ID NO: 10994 - DNA, 20 bp, Artificial Sequence
  Description of Artificial Sequence: Synthetic oligonucleotide
cagttggctgtggacagcca

SEQ ID NO: 10995 - DNA, 20 bp, Artificial Sequence
  Description of Artificial Sequence: Synthetic oligonucleotide
agttggctgtggacagccac

SEQ ID NO: 10996 - DNA, 20 bp, Artificial Sequence
  Description of Artificial Sequence: Synthetic oligonucleotide
gttggctgtggacagccaca

SEQ ID NO: 10997 - DNA, 20 bp, Artificial Sequence
  Description of Artificial Sequence: Synthetic oligonucleotide
ttggctgtggacagccacag

SEQ ID NO: 10998 - DNA, 20 bp, Artificial Sequence
  Description of Artificial Sequence: Synthetic oligonucleotide
tggctgtggacagccacaga

SEQ ID NO: 10999 - DNA, 20 bp, Artificial Sequence
  Description of Artificial Sequence: Synthetic oligonucleotide
ggctgtggacagccacagat

SEQ ID NO: 11000 - DNA, 20 bp, Artificial Sequence
  Description of Artificial Sequence: Synthetic oligonucleotide
gctgtggacagccacagatg

SEQ ID NO: 11001 - DNA, 20 bp, Artificial Sequence
  Description of Artificial Sequence: Synthetic oligonucleotide
ctgtggacagccacagatgc

SEQ ID NO: 11002 - DNA, 20 bp, Artificial Sequence
  Description of Artificial Sequence: Synthetic oligonucleotide
tgtggacagccacagatgca

SEQ ID NO: 11003 - DNA, 20 bp, Artificial Sequence
  Description of Artificial Sequence: Synthetic oligonucleotide
gtggacagccacagatgcag

SEQ ID NO: 11004 - DNA, 20 bp, Artificial Sequence
  Description of Artificial Sequence: Synthetic oligonucleotide
tggacagccacagatgcagg

SEQ ID NO: 11005 - DNA, 20 bp, Artificial Sequence
  Description of Artificial Sequence: Synthetic oligonucleotide
ggacagccacagatgcaggg

SEQ ID NO: 11006 - DNA, 20 bp, Artificial Sequence
  Description of Artificial Sequence: Synthetic oligonucleotide
gacagccacagatgcaggga

SEQ ID NO: 11007 - DNA, 20 bp, Artificial Sequence
  Description of Artificial Sequence: Synthetic oligonucleotide
acagccacagatgcagggaa

SEQ ID NO: 11008 - DNA, 20 bp, Artificial Sequence
  Description of Artificial Sequence: Synthetic oligonucleotide
cagccacagatgcagggaag

SEQ ID NO: 11009 - DNA, 20 bp, Artificial Sequence
  Description of Artificial Sequence: Synthetic oligonucleotide
agccacagatgcagggaagg

SEQ ID NO: 11010 - DNA, 20 bp, Artificial Sequence
  Description of Artificial Sequence: Synthetic oligonucleotide
gccacagatgcagggaagga

SEQ ID NO: 11011 - DNA, 20 bp, Artificial Sequence
  Description of Artificial Sequence: Synthetic oligonucleotide
ccacagatgcagggaaggat

SEQ ID NO: 11012 - DNA, 20 bp, Artificial Sequence
  Description of Artificial Sequence: Synthetic oligonucleotide
cacagatgcagggaaggatg

SEQ ID NO: 11013 - DNA, 20 bp, Artificial Sequence
  Description of Artificial Sequence: Synthetic oligonucleotide
acagatgcagggaaggatga

SEQ ID NO: 11014 - DNA, 20 bp, Artificial Sequence
  Description of Artificial Sequence: Synthetic oligonucleotide
cagatgcagggaaggatgag

SEQ ID NO: 11015 - DNA, 20 bp, Artificial Sequence
  Description of Artificial Sequence: Synthetic oligonucleotide
agatgcagggaaggatgagg

SEQ ID NO: 11016 - DNA, 20 bp, Artificial Sequence
  Description of Artificial Sequence: Synthetic oligonucleotide
gatgcagggaaggatgagga

SEQ ID NO: 11017 - DNA, 20 bp, Artificial Sequence
  Description of Artificial Sequence: Synthetic oligonucleotide
atgcagggaaggatgaggac

SEQ ID NO: 11018 - DNA, 20 bp, Artificial Sequence
  Description of Artificial Sequence: Synthetic oligonucleotide
tgcagggaaggatgaggacc

SEQ ID NO: 11019 - DNA, 20 bp, Artificial Sequence
  Description of Artificial Sequence: Synthetic oligonucleotide
gcagggaaggatgaggacca

SEQ ID NO: 11020 - DNA, 20 bp, Artificial Sequence
  Description of Artificial Sequence: Synthetic oligonucleotide
cagggaaggatgaggaccac

SEQ ID NO: 11021 - DNA, 20 bp, Artificial Sequence
  Description of Artificial Sequence: Synthetic oligonucleotide
agggaaggatgaggaccaca

SEQ ID NO: 11022 - DNA, 20 bp, Artificial Sequence
  Description of Artificial Sequence: Synthetic oligonucleotide
gggaaggatgaggaccacag

SEQ ID NO: 11023 - DNA, 20 bp, Artificial Sequence
  Description of Artificial Sequence: Synthetic oligonucleotide
ggaaggatgaggaccacaga

SEQ ID NO: 11024 - DNA, 20 bp, Artificial Sequence
  Description of Artificial Sequence: Synthetic oligonucleotide
gaaggatgaggaccacagag

SEQ ID NO: 11025 - DNA, 20 bp, Artificial Sequence
  Description of Artificial Sequence: Synthetic oligonucleotide
aaggatgaggaccacagaga

SEQ ID NO: 11026 - DNA, 20 bp, Artificial Sequence
  Description of Artificial Sequence: Synthetic oligonucleotide
aggatgaggaccacagagaa

SEQ ID NO: 11027 - DNA, 20 bp, Artificial Sequence
  Description of Artificial Sequence: Synthetic oligonucleotide
ggatgaggaccacagagaaa

SEQ ID NO: 11028 - DNA, 20 bp, Artificial Sequence
  Description of Artificial Sequence: Synthetic oligonucleotide
gatgaggaccacagagaaac

SEQ ID NO: 11029 - DNA, 20 bp, Artificial Sequence
  Description of Artificial Sequence: Synthetic oligonucleotide
atgaggaccacagagaaacc

SEQ ID NO: 11030 - DNA, 20 bp, Artificial Sequence
  Description of Artificial Sequence: Synthetic oligonucleotide
tgaggaccacagagaaaccg

SEQ ID NO: 11031 - DNA, 20 bp, Artificial Sequence
  Description of Artificial Sequence: Synthetic oligonucleotide
gaggaccacagagaaaccgt

SEQ ID NO: 11032 - DNA, 20 bp, Artificial Sequence
  Description of Artificial Sequence: Synthetic oligonucleotide
aggaccacagagaaaccgtg

SEQ ID NO: 11033 - DNA, 20 bp, Artificial Sequence
  Description of Artificial Sequence: Synthetic oligonucleotide
ggaccacagagaaaccgtgt

SEQ ID NO: 11034 - DNA, 20 bp, Artificial Sequence
  Description of Artificial Sequence: Synthetic oligonucleotide
gaccacagagaaaccgtgtg

SEQ ID NO: 11035 - DNA, 20 bp, Artificial Sequence
  Description of Artificial Sequence: Synthetic oligonucleotide
accacagagaaaccgtgtgg

SEQ ID NO: 11036 - DNA, 20 bp, Artificial Sequence
  Description of Artificial Sequence: Synthetic oligonucleotide
ccacagagaaaccgtgtggg

SEQ ID NO: 11037 - DNA, 20 bp, Artificial Sequence
  Description of Artificial Sequence: Synthetic oligonucleotide
cacagagaaaccgtgtgggg

SEQ ID NO: 11038 - DNA, 20 bp, Artificial Sequence
  Description of Artificial Sequence: Synthetic oligonucleotide
acagagaaaccgtgtggggc

SEQ ID NO: 11039 - DNA, 20 bp, Artificial Sequence
  Description of Artificial Sequence: Synthetic oligonucleotide
cagagaaaccgtgtggggcc

SEQ ID NO: 11040 - DNA, 20 bp, Artificial Sequence
  Description of Artificial Sequence: Synthetic oligonucleotide
agagaaaccgtgtggggccg

SEQ ID NO: 11041 - DNA, 20 bp, Artificial Sequence
  Description of Artificial Sequence: Synthetic oligonucleotide
gagaaaccgtgtggggccgt

SEQ ID NO: 11042 - DNA, 20 bp, Artificial Sequence
  Description of Artificial Sequence: Synthetic oligonucleotide
agaaaccgtgtggggccgtg

SEQ ID NO: 11043 - DNA, 20 bp, Artificial Sequence
  Description of Artificial Sequence: Synthetic oligonucleotide
gaaaccgtgtggggccgtga

SEQ ID NO: 11044 - DNA, 20 bp, Artificial Sequence
  Description of Artificial Sequence: Synthetic oligonucleotide
aaaccgtgtggggccgtgaa

SEQ ID NO: 11045 - DNA, 20 bp, Artificial Sequence
  Description of Artificial Sequence: Synthetic oligonucleotide
aaccgtgtggggccgtgaac

SEQ ID NO: 11046 - DNA, 20 bp, Artificial Sequence
  Description of Artificial Sequence: Synthetic oligonucleotide
accgtgtggggccgtgaact

SEQ ID NO: 11047 - DNA, 20 bp, Artificial Sequence
  Description of Artificial Sequence: Synthetic oligonucleotide
ccgtgtggggccgtgaactt

SEQ ID NO: 11048 - DNA, 20 bp, Artificial Sequence
  Description of Artificial Sequence: Synthetic oligonucleotide
cgtgtggggccgtgaactta

SEQ ID NO: 11049 - DNA, 20 bp, Artificial Sequence
  Description of Artificial Sequence: Synthetic oligonucleotide
gtgtggggccgtgaacttag

SEQ ID NO: 11050 - DNA, 20 bp, Artificial Sequence
  Description of Artificial Sequence: Synthetic oligonucleotide
tgtggggccgtgaacttaga

SEQ ID NO: 11051 - DNA, 20 bp, Artificial Sequence
  Description of Artificial Sequence: Synthetic oligonucleotide
gtggggccgtgaacttagag

SEQ ID NO: 11052 - DNA, 20 bp, Artificial Sequence
  Description of Artificial Sequence: Synthetic oligonucleotide
tggggccgtgaacttagaga

SEQ ID NO: 11053 - DNA, 20 bp, Artificial Sequence
  Description of Artificial Sequence: Synthetic oligonucleotide
ggggccgtgaacttagagaa

SEQ ID NO: 11054 - DNA, 20 bp, Artificial Sequence
  Description of Artificial Sequence: Synthetic oligonucleotide
gggccgtgaacttagagaac

SEQ ID NO: 11055 - DNA, 20 bp, Artificial Sequence
  Description of Artificial Sequence: Synthetic oligonucleotide
ggccgtgaacttagagaacc

SEQ ID NO: 11056 - DNA, 20 bp, Artificial Sequence
  Description of Artificial Sequence: Synthetic oligonucleotide
gccgtgaacttagagaaccg

SEQ ID NO: 11057 - DNA, 20 bp, Artificial Sequence
  Description of Artificial Sequence: Synthetic oligonucleotide
ccgtgaacttagagaaccgc

SEQ ID NO: 11058 - DNA, 20 bp, Artificial Sequence
  Description of Artificial Sequence: Synthetic oligonucleotide
cgtgaacttagagaaccgcg

SEQ ID NO: 11059 - DNA, 20 bp, Artificial Sequence
  Description of Artificial Sequence: Synthetic oligonucleotide
gtgaacttagagaaccgcga

SEQ ID NO: 11060 - DNA, 20 bp, Artificial Sequence
  Description of Artificial Sequence: Synthetic oligonucleotide
tgaacttagagaaccgcgag

SEQ ID NO: 11061 - DNA, 20 bp, Artificial Sequence
  Description of Artificial Sequence: Synthetic oligonucleotide
gaacttagagaaccgcgagt

SEQ ID NO: 11062 - DNA, 20 bp, Artificial Sequence
  Description of Artificial Sequence: Synthetic oligonucleotide
aacttagagaaccgcgagtc

SEQ ID NO: 11063 - DNA, 20 bp, Artificial Sequence
  Description of Artificial Sequence: Synthetic oligonucleotide
acttagagaaccgcgagtct

SEQ ID NO: 11064 - DNA, 20 bp, Artificial Sequence
  Description of Artificial Sequence: Synthetic oligonucleotide
cttagagaaccgcgagtctg

SEQ ID NO: 11065 - DNA, 20 bp, Artificial Sequence
  Description of Artificial Sequence: Synthetic oligonucleotide
ttagagaaccgcgagtctgc

SEQ ID NO: 11066 - DNA, 20 bp, Artificial Sequence
  Description of Artificial Sequence: Synthetic oligonucleotide
tagagaaccgcgagtctgca

SEQ ID NO: 11067 - DNA, 20 bp, Artificial Sequence
  Description of Artificial Sequence: Synthetic oligonucleotide
agagaaccgcgagtctgcat

SEQ ID NO: 11068 - DNA, 20 bp, Artificial Sequence
  Description of Artificial Sequence: Synthetic oligonucleotide
gagaaccgcgagtctgcatc

SEQ ID NO: 11069 - DNA, 20 bp, Artificial Sequence
  Description of Artificial Sequence: Synthetic oligonucleotide
agaaccgcgagtctgcatcg

SEQ ID NO: 11070 - DNA, 20 bp, Artificial Sequence
  Description of Artificial Sequence: Synthetic oligonucleotide
gaaccgcgagtctgcatcgg

SEQ ID NO: 11071 - DNA, 20 bp, Artificial Sequence
  Description of Artificial Sequence: Synthetic oligonucleotide
aaccgcgagtctgcatcgga

SEQ ID NO: 11072 - DNA, 20 bp, Artificial Sequence
  Description of Artificial Sequence: Synthetic oligonucleotide
accgcgagtctgcatcggac

SEQ ID NO: 11073 - DNA, 20 bp, Artificial Sequence
  Description of Artificial Sequence: Synthetic oligonucleotide
ccgcgagtctgcatcggaca

SEQ ID NO: 11074 - DNA, 20 bp, Artificial Sequence
  Description of Artificial Sequence: Synthetic oligonucleotide
cgcgagtctgcatcggacac

SEQ ID NO: 11075 - DNA, 20 bp, Artificial Sequence
  Description of Artificial Sequence: Synthetic oligonucleotide
gcgagtctgcatcggacaca

SEQ ID NO: 11076 - DNA, 20 bp, Artificial Sequence
  Description of Artificial Sequence: Synthetic oligonucleotide
cgagtctgcatcggacacac

SEQ ID NO: 11077 - DNA, 20 bp, Artificial Sequence
  Description of Artificial Sequence: Synthetic oligonucleotide
gagtctgcatcggacacacg

SEQ ID NO: 11078 - DNA, 20 bp, Artificial Sequence
  Description of Artificial Sequence: Synthetic oligonucleotide
agtctgcatcggacacacgt

SEQ ID NO: 11079 - DNA, 20 bp, Artificial Sequence
  Description of Artificial Sequence: Synthetic oligonucleotide
gtctgcatcggacacacgtg

SEQ ID NO: 11080 - DNA, 20 bp, Artificial Sequence
  Description of Artificial Sequence: Synthetic oligonucleotide
tctgcatcggacacacgtgg

SEQ ID NO: 11081 - DNA, 20 bp, Artificial Sequence
  Description of Artificial Sequence: Synthetic oligonucleotide
ctgcatcggacacacgtgga

SEQ ID NO: 11082 - DNA, 20 bp, Artificial Sequence
  Description of Artificial Sequence: Synthetic oligonucleotide
tgcatcggacacacgtggac

SEQ ID NO: 11083 - DNA, 20 bp, Artificial Sequence
  Description of Artificial Sequence: Synthetic oligonucleotide
gcatcggacacacgtggaca

SEQ ID NO: 11084 - DNA, 20 bp, Artificial Sequence
  Description of Artificial Sequence: Synthetic oligonucleotide
catcggacacacgtggacat

SEQ ID NO: 11085 - DNA, 20 bp, Artificial Sequence
  Description of Artificial Sequence: Synthetic oligonucleotide
atcggacacacgtggacatg

SEQ ID NO: 11086 - DNA, 20 bp, Artificial Sequence
  Description of Artificial Sequence: Synthetic oligonucleotide
tcggacacacgtggacatgc

SEQ ID NO: 11087 - DNA, 20 bp, Artificial Sequence
  Description of Artificial Sequence: Synthetic oligonucleotide
cggacacacgtggacatgct

SEQ ID NO: 11088 - DNA, 20 bp, Artificial Sequence
  Description of Artificial Sequence: Synthetic oligonucleotide
ggacacacgtggacatgctg

SEQ ID NO: 11089 - DNA, 20 bp, Artificial Sequence
  Description of Artificial Sequence: Synthetic oligonucleotide
gacacacgtggacatgctgt

SEQ ID NO: 11090 - DNA, 20 bp, Artificial Sequence
  Description of Artificial Sequence: Synthetic oligonucleotide
acacacgtggacatgctgtg

SEQ ID NO: 11091 - DNA, 20 bp, Artificial Sequence
  Description of Artificial Sequence: Synthetic oligonucleotide
cacacgtggacatgctgtgg

SEQ ID NO: 11092 - DNA, 20 bp, Artificial Sequence
  Description of Artificial Sequence: Synthetic oligonucleotide
acacgtggacatgctgtggt

SEQ ID NO: 11093 - DNA, 20 bp, Artificial Sequence
  Description of Artificial Sequence: Synthetic oligonucleotide
cacgtggacatgctgtggtt

SEQ ID NO: 11094 - DNA, 20 bp, Artificial Sequence
  Description of Artificial Sequence: Synthetic oligonucleotide
acgtggacatgctgtggttc

SEQ ID NO: 11095 - DNA, 20 bp, Artificial Sequence
  Description of Artificial Sequence: Synthetic oligonucleotide
cgtggacatgctgtggttcg

SEQ ID NO: 11096 - DNA, 20 bp, Artificial Sequence
  Description of Artificial Sequence: Synthetic oligonucleotide
gtggacatgctgtggttcga

SEQ ID NO: 11097 - DNA, 20 bp, Artificial Sequence
  Description of Artificial Sequence: Synthetic oligonucleotide
tggacatgctgtggttcgag

SEQ ID NO: 11098 - DNA, 20 bp, Artificial Sequence
  Description of Artificial Sequence: Synthetic oligonucleotide
ggacatgctgtggttcgaga

SEQ ID NO: 11099 - DNA, 20 bp, Artificial Sequence
  Description of Artificial Sequence: Synthetic oligonucleotide
gacatgctgtggttcgagat

SEQ ID NO: 11100 - DNA, 20 bp, Artificial Sequence
  Description of Artificial Sequence: Synthetic oligonucleotide
acatgctgtggttcgagatg

SEQ ID NO: 11101 - DNA, 20 bp, Artificial Sequence
  Description of Artificial Sequence: Synthetic oligonucleotide
catgctgtggttcgagatga

SEQ ID NO: 11102 - DNA, 20 bp, Artificial Sequence
  Description of Artificial Sequence: Synthetic oligonucleotide
atgctgtggttcgagatgaa

SEQ ID NO: 11103 - DNA, 20 bp, Artificial Sequence
  Description of Artificial Sequence: Synthetic oligonucleotide
tgctgtggttcgagatgaac

SEQ ID NO: 11104 - DNA, 20 bp, Artificial Sequence
  Description of Artificial Sequence: Synthetic oligonucleotide
gctgtggttcgagatgaacg

SEQ ID NO: 11105 - DNA, 20 bp, Artificial Sequence
  Description of Artificial Sequence: Synthetic oligonucleotide
ctgtggttcgagatgaacgg

SEQ ID NO: 11106 - DNA, 20 bp, Artificial Sequence
  Description of Artificial Sequence: Synthetic oligonucleotide
tgtggttcgagatgaacgga

SEQ ID NO: 11107 - DNA, 20 bp, Artificial Sequence
  Description of Artificial Sequence: Synthetic oligonucleotide
gtggttcgagatgaacggag

SEQ ID NO: 11108 - DNA, 20 bp, Artificial Sequence
  Description of Artificial Sequence: Synthetic oligonucleotide
tggttcgagatgaacggaga

SEQ ID NO: 11109 - DNA, 20 bp, Artificial Sequence
  Description of Artificial Sequence: Synthetic oligonucleotide
ggttcgagatgaacggagat

SEQ ID NO: 11110 - DNA, 20 bp, Artificial Sequence
  Description of Artificial Sequence: Synthetic oligonucleotide
gttcgagatgaacggagatt

SEQ ID NO: 11111 - DNA, 20 bp, Artificial Sequence
  Description of Artificial Sequence: Synthetic oligonucleotide
ttcgagatgaacggagattt

SEQ ID NO: 11112 - DNA, 20 bp, Artificial Sequence
  Description of Artificial Sequence: Synthetic oligonucleotide
tcgagatgaacggagatttg

SEQ ID NO: 11113 - DNA, 20 bp, Artificial Sequence
  Description of Artificial Sequence: Synthetic oligonucleotide
cgagatgaacggagatttgg

SEQ ID NO: 11114 - DNA, 20 bp, Artificial Sequence
  Description of Artificial Sequence: Synthetic oligonucleotide
gagatgaacggagatttggg

SEQ ID NO: 11115 - DNA, 20 bp, Artificial Sequence
  Description of Artificial Sequence: Synthetic oligonucleotide
agatgaacggagatttggga

SEQ ID NO: 11116 - DNA, 20 bp, Artificial Sequence
  Description of Artificial Sequence: Synthetic oligonucleotide
gatgaacggagatttgggaa

SEQ ID NO: 11117 - DNA, 20 bp, Artificial Sequence
  Description of Artificial Sequence: Synthetic oligonucleotide
atgaacggagatttgggaat

SEQ ID NO: 11118 - DNA, 20 bp, Artificial Sequence
  Description of Artificial Sequence: Synthetic oligonucleotide
tgaacggagatttgggaata

SEQ ID NO: 11119 - DNA, 20 bp, Artificial Sequence
  Description of Artificial Sequence: Synthetic oligonucleotide
gaacggagatttgggaataa

SEQ ID NO: 11120 - DNA, 20 bp, Artificial Sequence
  Description of Artificial Sequence: Synthetic oligonucleotide
aacggagatttgggaataaa

SEQ ID NO: 11121 - DNA, 20 bp, Artificial Sequence
  Description of Artificial Sequence: Synthetic oligonucleotide
acggagatttgggaataaag

SEQ ID NO: 11122 - DNA, 20 bp, Artificial Sequence
  Description of Artificial Sequence: Synthetic oligonucleotide
cggagatttgggaataaagc

SEQ ID NO: 11123 - DNA, 20 bp, Artificial Sequence
  Description of Artificial Sequence: Synthetic oligonucleotide
ggagatttgggaataaagca

SEQ ID NO: 11124 - DNA, 20 bp, Artificial Sequence
  Description of Artificial Sequence: Synthetic oligonucleotide
gagatttgggaataaagcac

SEQ ID NO: 11125 - DNA, 20 bp, Artificial Sequence
  Description of Artificial Sequence: Synthetic oligonucleotide
agatttgggaataaagcacc

SEQ ID NO: 11126 - DNA, 20 bp, Artificial Sequence
  Description of Artificial Sequence: Synthetic oligonucleotide
gatttgggaataaagcacct

SEQ ID NO: 11127 - DNA, 20 bp, Artificial Sequence
  Description of Artificial Sequence: Synthetic oligonucleotide
atttgggaataaagcaccta

SEQ ID NO: 11128 - DNA, 20 bp, Artificial Sequence
  Description of Artificial Sequence: Synthetic oligonucleotide
tttgggaataaagcacctac

SEQ ID NO: 11129 - DNA, 20 bp, Artificial Sequence
  Description of Artificial Sequence: Synthetic oligonucleotide
ttgggaataaagcacctaca

SEQ ID NO: 11130 - DNA, 20 bp, Artificial Sequence
  Description of Artificial Sequence: Synthetic oligonucleotide
tgggaataaagcacctacaa

SEQ ID NO: 11131 - DNA, 20 bp, Artificial Sequence
  Description of Artificial Sequence: Synthetic oligonucleotide
gggaataaagcacctacaac

SEQ ID NO: 11132 - DNA, 20 bp, Artificial Sequence
  Description of Artificial Sequence: Synthetic oligonucleotide
ggaataaagcacctacaact

SEQ ID NO: 11133 - DNA, 20 bp, Artificial Sequence
  Description of Artificial Sequence: Synthetic oligonucleotide
gaataaagcacctacaactt

SEQ ID NO: 11134 - DNA, 20 bp, Artificial Sequence
  Description of Artificial Sequence: Synthetic oligonucleotide
aataaagcacctacaacttg

SEQ ID NO: 11135 - DNA, 20 bp, Artificial Sequence
  Description of Artificial Sequence: Synthetic oligonucleotide
ataaagcacctacaacttgt

SEQ ID NO: 11136 - DNA, 20 bp, Artificial Sequence
  Description of Artificial Sequence: Synthetic oligonucleotide
taaagcacctacaacttgtg

SEQ ID NO: 11137 - DNA, 20 bp, Artificial Sequence
  Description of Artificial Sequence: Synthetic oligonucleotide
aaagcacctacaacttgtgg

SEQ ID NO: 11138 - DNA, 20 bp, Artificial Sequence
  Description of Artificial Sequence: Synthetic oligonucleotide
aagcacctacaacttgtggt

SEQ ID NO: 11139 - DNA, 20 bp, Artificial Sequence
  Description of Artificial Sequence: Synthetic oligonucleotide
agcacctacaacttgtggtg

SEQ ID NO: 11140 - DNA, 20 bp, Artificial Sequence
  Description of Artificial Sequence: Synthetic oligonucleotide
gcacctacaacttgtggtgg

SEQ ID NO: 11141 - DNA, 20 bp, Artificial Sequence
  Description of Artificial Sequence: Synthetic oligonucleotide
cacctacaacttgtggtggc

SEQ ID NO: 11142 - DNA, 20 bp, Artificial Sequence
  Description of Artificial Sequence: Synthetic oligonucleotide
acctacaacttgtggtggca

SEQ ID NO: 11143 - DNA, 20 bp, Artificial Sequence
  Description of Artificial Sequence: Synthetic oligonucleotide
cctacaacttgtggtggcag

SEQ ID NO: 11144 - DNA, 20 bp, Artificial Sequence
  Description of Artificial Sequence: Synthetic oligonucleotide
ctacaacttgtggtggcagc

SEQ ID NO: 11145 - DNA, 20 bp, Artificial Sequence
  Description of Artificial Sequence: Synthetic oligonucleotide
tacaacttgtggtggcagca

SEQ ID NO: 11146 - DNA, 20 bp, Artificial Sequence
  Description of Artificial Sequence: Synthetic oligonucleotide
acaacttgtggtggcagcaa

SEQ ID NO: 11147 - DNA, 20 bp, Artificial Sequence
  Description of Artificial Sequence: Synthetic oligonucleotide
caacttgtggtggcagcaaa

SEQ ID NO: 11148 - DNA, 20 bp, Artificial Sequence
  Description of Artificial Sequence: Synthetic oligonucleotide
aacttgtggtggcagcaaaa

SEQ ID NO: 11149 - DNA, 20 bp, Artificial Sequence
  Description of Artificial Sequence: Synthetic oligonucleotide
acttgtggtggcagcaaaag

SEQ ID NO: 11150 - DNA, 20 bp, Artificial Sequence
  Description of Artificial Sequence: Synthetic oligonucleotide
cttgtggtggcagcaaaagc

SEQ ID NO: 11151 - DNA, 20 bp, Artificial Sequence
  Description of Artificial Sequence: Synthetic oligonucleotide
ttgtggtggcagcaaaagcc

SEQ ID NO: 11152 - DNA, 20 bp, Artificial Sequence
  Description of Artificial Sequence: Synthetic oligonucleotide
tgtggtggcagcaaaagccc

SEQ ID NO: 11153 - DNA, 20 bp, Artificial Sequence
  Description of Artificial Sequence: Synthetic oligonucleotide
gtggtggcagcaaaagccca

SEQ ID NO: 11154 - DNA, 20 bp, Artificial Sequence
  Description of Artificial Sequence: Synthetic oligonucleotide
tggtggcagcaaaagcccac

SEQ ID NO: 11155 - DNA, 20 bp, Artificial Sequence
  Description of Artificial Sequence: Synthetic oligonucleotide
ggtggcagcaaaagcccact

SEQ ID NO: 11156 - DNA, 20 bp, Artificial Sequence
  Description of Artificial Sequence: Synthetic oligonucleotide
gtggcagcaaaagcccactt

SEQ ID NO: 11157 - DNA, 20 bp, Artificial Sequence
  Description of Artificial Sequence: Synthetic oligonucleotide
tggcagcaaaagcccacttt

SEQ ID NO: 11158 - DNA, 20 bp, Artificial Sequence
  Description of Artificial Sequence: Synthetic oligonucleotide
ggcagcaaaagcccactttc

SEQ ID NO: 11159 - DNA, 20 bp, Artificial Sequence
  Description of Artificial Sequence: Synthetic oligonucleotide
gcagcaaaagcccactttct

SEQ ID NO: 11160 - DNA, 20 bp, Artificial Sequence
  Description of Artificial Sequence: Synthetic oligonucleotide
cagcaaaagcccactttctg

SEQ ID NO: 11161 - DNA, 20 bp, Artificial Sequence
  Description of Artificial Sequence: Synthetic oligonucleotide
agcaaaagcccactttctgc

SEQ ID NO: 11162 - DNA, 20 bp, Artificial Sequence
  Description of Artificial Sequence: Synthetic oligonucleotide
gcaaaagcccactttctgcg

SEQ ID NO: 11163 - DNA, 20 bp, Artificial Sequence
  Description of Artificial Sequence: Synthetic oligonucleotide
caaaagcccactttctgcgg

SEQ ID NO: 11164 - DNA, 20 bp, Artificial Sequence
  Description of Artificial Sequence: Synthetic oligonucleotide
aaaagcccactttctgcggt

SEQ ID NO: 11165 - DNA, 20 bp, Artificial Sequence
  Description of Artificial Sequence: Synthetic oligonucleotide
aaagcccactttctgcggtg

SEQ ID NO: 11166 - DNA, 20 bp, Artificial Sequence
  Description of Artificial Sequence: Synthetic oligonucleotide
aagcccactttctgcggtgg

SEQ ID NO: 11167 - DNA, 20 bp, Artificial Sequence
  Description of Artificial Sequence: Synthetic oligonucleotide
agcccactttctgcggtggg

SEQ ID NO: 11168 - DNA, 20 bp, Artificial Sequence
  Description of Artificial Sequence: Synthetic oligonucleotide
gcccactttctgcggtgggg

SEQ ID NO: 11169 - DNA, 20 bp, Artificial Sequence
  Description of Artificial Sequence: Synthetic oligonucleotide
cccactttctgcggtgggga

SEQ ID NO: 11170 - DNA, 20 bp, Artificial Sequence
  Description of Artificial Sequence: Synthetic oligonucleotide
ccactttctgcggtggggag

SEQ ID NO: 11171 - DNA, 20 bp, Artificial Sequence
  Description of Artificial Sequence: Synthetic oligonucleotide
cactttctgcggtggggagg

SEQ ID NO: 11172 - DNA, 20 bp, Artificial Sequence
  Description of Artificial Sequence: Synthetic oligonucleotide
actttctgcggtggggaggg

SEQ ID NO: 11173 - DNA, 20 bp, Artificial Sequence
  Description of Artificial Sequence: Synthetic oligonucleotide
ctttctgcggtggggagggg

SEQ ID NO: 11174 - DNA, 20 bp, Artificial Sequence
  Description of Artificial Sequence: Synthetic oligonucleotide
tttctgcggtggggaggggg

SEQ ID NO: 11175 - DNA, 20 bp, Artificial Sequence
  Description of Artificial Sequence: Synthetic oligonucleotide
ttctgcggtggggagggggc

SEQ ID NO: 11176 - DNA, 20 bp, Artificial Sequence
  Description of Artificial Sequence: Synthetic oligonucleotide
tctgcggtggggagggggcc

SEQ ID NO: 11177 - DNA, 20 bp, Artificial Sequence
  Description of Artificial Sequence: Synthetic oligonucleotide
ctgcggtggggagggggccg

SEQ ID NO: 11178 - DNA, 20 bp, Artificial Sequence
  Description of Artificial Sequence: Synthetic oligonucleotide
tgcggtggggagggggccgg

SEQ ID NO: 11179 - DNA, 20 bp, Artificial Sequence
  Description of Artificial Sequence: Synthetic oligonucleotide
gcggtggggagggggccggc

SEQ ID NO: 11180 - DNA, 20 bp, Artificial Sequence
  Description of Artificial Sequence: Synthetic oligonucleotide
cggtggggagggggccggcg

SEQ ID NO: 11181 - DNA, 20 bp, Artificial Sequence
  Description of Artificial Sequence: Synthetic oligonucleotide
ggtggggagggggccggcgg

SEQ ID NO: 11182 - DNA, 20 bp, Artificial Sequence
  Description of Artificial Sequence: Synthetic oligonucleotide
gtggggagggggccggcggg

SEQ ID NO: 11183 - DNA, 20 bp, Artificial Sequence
  Description of Artificial Sequence: Synthetic oligonucleotide
tggggagggggccggcgggg

SEQ ID NO: 11184 - DNA, 20 bp, Artificial Sequence
  Description of Artificial Sequence: Synthetic oligonucleotide
ggggagggggccggcggggg

SEQ ID NO: 11185 - DNA, 20 bp, Artificial Sequence
  Description of Artificial Sequence: Synthetic oligonucleotide
gggagggggccggcgggggc

SEQ ID NO: 11186 - DNA, 20 bp, Artificial Sequence
  Description of Artificial Sequence: Synthetic oligonucleotide
ggagggggccggcgggggcg

SEQ ID NO: 11187 - DNA, 20 bp, Artificial Sequence
  Description of Artificial Sequence: Synthetic oligonucleotide
gagggggccggcgggggcgg

SEQ ID NO: 11188 - DNA, 20 bp, Artificial Sequence
  Description of Artificial Sequence: Synthetic oligonucleotide
agggggccggcgggggcggg

SEQ ID NO: 11189 - DNA, 20 bp, Artificial Sequence
  Description of Artificial Sequence: Synthetic oligonucleotide
gggggccggcgggggcgggg

SEQ ID NO: 11190 - DNA, 20 bp, Artificial Sequence
  Description of Artificial Sequence: Synthetic oligonucleotide
ggggccggcgggggcgggga

SEQ ID NO: 11191 - DNA, 20 bp, Artificial Sequence
  Description of Artificial Sequence: Synthetic oligonucleotide
gggccggcgggggcggggag

SEQ ID NO: 11192 - DNA, 20 bp, Artificial Sequence
  Description of Artificial Sequence: Synthetic oligonucleotide
ggccggcgggggcggggagg

SEQ ID NO: 11193 - DNA, 20 bp, Artificial Sequence
  Description of Artificial Sequence: Synthetic oligonucleotide
gccggcgggggcggggaggg

SEQ ID NO: 11194 - DNA, 20 bp, Artificial Sequence
  Description of Artificial Sequence: Synthetic oligonucleotide
ccggcgggggcggggaggga

SEQ ID NO: 11195 - DNA, 20 bp, Artificial Sequence
  Description of Artificial Sequence: Synthetic oligonucleotide
cggcgggggcggggagggag

SEQ ID NO: 11196 - DNA, 20 bp, Artificial Sequence
  Description of Artificial Sequence: Synthetic oligonucleotide
ggcgggggcggggagggagg

SEQ ID NO: 11197 - DNA, 20 bp, Artificial Sequence
  Description of Artificial Sequence: Synthetic oligonucleotide
gcgggggcggggagggagga

SEQ ID NO: 11198 - DNA, 20 bp, Artificial Sequence
  Description of Artificial Sequence: Synthetic oligonucleotide
cgggggcggggagggaggag

SEQ ID NO: 11199 - DNA, 20 bp, Artificial Sequence
  Description of Artificial Sequence: Synthetic oligonucleotide
gggggcggggagggaggagg

SEQ ID NO: 11200 - DNA, 20 bp, Artificial Sequence
  Description of Artificial Sequence: Synthetic oligonucleotide
ggggcggggagggaggagga

SEQ ID NO: 11201 - DNA, 20 bp, Artificial Sequence
  Description of Artificial Sequence: Synthetic oligonucleotide
gggcggggagggaggaggag

SEQ ID NO: 11202 - DNA, 20 bp, Artificial Sequence
  Description of Artificial Sequence: Synthetic oligonucleotide
ggcggggagggaggaggaga

SEQ ID NO: 11203 - DNA, 20 bp, Artificial Sequence
  Description of Artificial Sequence: Synthetic oligonucleotide
gcggggagggaggaggagaa

SEQ ID NO: 11204 - DNA, 20 bp, Artificial Sequence
  Description of Artificial Sequence: Synthetic oligonucleotide
cggggagggaggaggagaac

SEQ ID NO: 11205 - DNA, 20 bp, Artificial Sequence
  Description of Artificial Sequence: Synthetic oligonucleotide
ggggagggaggaggagaaca

SEQ ID NO: 11206 - DNA, 20 bp, Artificial Sequence
  Description of Artificial Sequence: Synthetic oligonucleotide
gggagggaggaggagaacaa

SEQ ID NO: 11207 - DNA, 20 bp, Artificial Sequence
  Description of Artificial Sequence: Synthetic oligonucleotide
ggagggaggaggagaacaag

SEQ ID NO: 11208 - DNA, 20 bp, Artificial Sequence
  Description of Artificial Sequence: Synthetic oligonucleotide
gagggaggaggagaacaaga

SEQ ID NO: 11209 - DNA, 20 bp, Artificial Sequence
  Description of Artificial Sequence: Synthetic oligonucleotide
agggaggaggagaacaagag

SEQ ID NO: 11210 - DNA, 20 bp, Artificial Sequence
  Description of Artificial Sequence: Synthetic oligonucleotide
gggaggaggagaacaagaga

SEQ ID NO: 11211 - DNA, 20 bp, Artificial Sequence
  Description of Artificial Sequence: Synthetic oligonucleotide
ggaggaggagaacaagagag

SEQ ID NO: 11212 - DNA, 20 bp, Artificial Sequence
  Description of Artificial Sequence: Synthetic oligonucleotide
gaggaggagaacaagagagg

SEQ ID NO: 11213 - DNA, 20 bp, Artificial Sequence
  Description of Artificial Sequence: Synthetic oligonucleotide
aggaggagaacaagagagga

SEQ ID NO: 11214 - DNA, 20 bp, Artificial Sequence
  Description of Artificial Sequence: Synthetic oligonucleotide
ggaggagaacaagagaggaa

SEQ ID NO: 11215 - DNA, 20 bp, Artificial Sequence
  Description of Artificial Sequence: Synthetic oligonucleotide
gaggagaacaagagaggaag

SEQ ID NO: 11216 - DNA, 20 bp, Artificial Sequence
  Description of Artificial Sequence: Synthetic oligonucleotide
aggagaacaagagaggaagg

SEQ ID NO: 11217 - DNA, 20 bp, Artificial Sequence
  Description of Artificial Sequence: Synthetic oligonucleotide
ggagaacaagagaggaagga

SEQ ID NO: 11218 - DNA, 20 bp, Artificial Sequence
  Description of Artificial Sequence: Synthetic oligonucleotide
gagaacaagagaggaaggag

SEQ ID NO: 11219 - DNA, 20 bp, Artificial Sequence
  Description of Artificial Sequence: Synthetic oligonucleotide
agaacaagagaggaaggagg

SEQ ID NO: 11220 - DNA, 20 bp, Artificial Sequence
  Description of Artificial Sequence: Synthetic oligonucleotide
gaacaagagaggaaggagga

SEQ ID NO: 11221 - DNA, 20 bp, Artificial Sequence
  Description of Artificial Sequence: Synthetic oligonucleotide
aacaagagaggaaggaggaa

SEQ ID NO: 11222 - DNA, 20 bp, Artificial Sequence
  Description of Artificial Sequence: Synthetic oligonucleotide
acaagagaggaaggaggaag

SEQ ID NO: 11223 - DNA, 20 bp, Artificial Sequence
  Description of Artificial Sequence: Synthetic oligonucleotide
caagagaggaaggaggaaga

SEQ ID NO: 11224 - DNA, 20 bp, Artificial Sequence
  Description of Artificial Sequence: Synthetic oligonucleotide
aagagaggaaggaggaagag

SEQ ID NO: 11225 - DNA, 20 bp, Artificial Sequence
  Description of Artificial Sequence: Synthetic oligonucleotide
agagaggaaggaggaagagg

SEQ ID NO: 11226 - DNA, 20 bp, Artificial Sequence
  Description of Artificial Sequence: Synthetic oligonucleotide
gagaggaaggaggaagaggg

SEQ ID NO: 11227 - DNA, 20 bp, Artificial Sequence
  Description of Artificial Sequence: Synthetic oligonucleotide
agaggaaggaggaagagggg

SEQ ID NO: 11228 - DNA, 20 bp, Artificial Sequence
  Description of Artificial Sequence: Synthetic oligonucleotide
gaggaaggaggaagaggggt

SEQ ID NO: 11229 - DNA, 20 bp, Artificial Sequence
  Description of Artificial Sequence: Synthetic oligonucleotide
aggaaggaggaagaggggtc

SEQ ID NO: 11230 - DNA, 20 bp, Artificial Sequence
  Description of Artificial Sequence: Synthetic oligonucleotide
ggaaggaggaagaggggtca

SEQ ID NO: 11231 - DNA, 20 bp, Artificial Sequence
  Description of Artificial Sequence: Synthetic oligonucleotide
gaaggaggaagaggggtcag

SEQ ID NO: 11232 - DNA, 20 bp, Artificial Sequence
  Description of Artificial Sequence: Synthetic oligonucleotide
aaggaggaagaggggtcagg

SEQ ID NO: 11233 - DNA, 20 bp, Artificial Sequence
  Description of Artificial Sequence: Synthetic oligonucleotide
aggaggaagaggggtcaggg

SEQ ID NO: 11234 - DNA, 20 bp, Artificial Sequence
  Description of Artificial Sequence: Synthetic oligonucleotide
ggaggaagaggggtcaggga

SEQ ID NO: 11235 - DNA, 20 bp, Artificial Sequence
  Description of Artificial Sequence: Synthetic oligonucleotide
gaggaagaggggtcagggac

SEQ ID NO: 11236 - DNA, 20 bp, Artificial Sequence
  Description of Artificial Sequence: Synthetic oligonucleotide
aggaagaggggtcagggacc

SEQ ID NO: 11237 - DNA, 20 bp, Artificial Sequence
  Description of Artificial Sequence: Synthetic oligonucleotide
ggaagaggggtcagggacct

SEQ ID NO: 11238 - DNA, 20 bp, Artificial Sequence
  Description of Artificial Sequence: Synthetic oligonucleotide
gaagaggggtcagggacctg

SEQ ID NO: 11239 - DNA, 20 bp, Artificial Sequence
  Description of Artificial Sequence: Synthetic oligonucleotide
aagaggggtcagggacctgg

SEQ ID NO: 11240 - DNA, 20 bp, Artificial Sequence
  Description of Artificial Sequence: Synthetic oligonucleotide
agaggggtcagggacctgga

SEQ ID NO: 11241 - DNA, 20 bp, Artificial Sequence
  Description of Artificial Sequence: Synthetic oligonucleotide
gaggggtcagggacctggag

SEQ ID NO: 11242 - DNA, 20 bp, Artificial Sequence
  Description of Artificial Sequence: Synthetic oligonucleotide
aggggtcagggacctggagc

SEQ ID NO: 11243 - DNA, 20 bp, Artificial Sequence
  Description of Artificial Sequence: Synthetic oligonucleotide
ggggtcagggacctggagca

SEQ ID NO: 11244 - DNA, 20 bp, Artificial Sequence
  Description of Artificial Sequence: Synthetic oligonucleotide
gggtcagggacctggagcat

SEQ ID NO: 11245 - DNA, 20 bp, Artificial Sequence
  Description of Artificial Sequence: Synthetic oligonucleotide
ggtcagggacctggagcatt

SEQ ID NO: 11246 - DNA, 20 bp, Artificial Sequence
  Description of Artificial Sequence: Synthetic oligonucleotide
gtcagggacctggagcattg

SEQ ID NO: 11247 - DNA, 20 bp, Artificial Sequence
  Description of Artificial Sequence: Synthetic oligonucleotide
tcagggacctggagcattgg

SEQ ID NO: 11248 - DNA, 20 bp, Artificial Sequence
  Description of Artificial Sequence: Synthetic oligonucleotide
cagggacctggagcattgga

SEQ ID NO: 11249 - DNA, 20 bp, Artificial Sequence
  Description of Artificial Sequence: Synthetic oligonucleotide
agggacctggagcattggat

SEQ ID NO: 11250 - DNA, 20 bp, Artificial Sequence
  Description of Artificial Sequence: Synthetic oligonucleotide
gggacctggagcattggatt

SEQ ID NO: 11251 - DNA, 20 bp, Artificial Sequence
  Description of Artificial Sequence: Synthetic oligonucleotide
ggacctggagcattggattt

SEQ ID NO: 11252 - DNA, 20 bp, Artificial Sequence
  Description of Artificial Sequence: Synthetic oligonucleotide
gacctggagcattggatttg

SEQ ID NO: 11253 - DNA, 20 bp, Artificial Sequence
  Description of Artificial Sequence: Synthetic oligonucleotide
acctggagcattggatttgt

SEQ ID NO: 11254 - DNA, 20 bp, Artificial Sequence
  Description of Artificial Sequence: Synthetic oligonucleotide
cctggagcattggatttgta

SEQ ID NO: 11255 - DNA, 20 bp, Artificial Sequence
  Description of Artificial Sequence: Synthetic oligonucleotide
ctggagcattggatttgtaa

SEQ ID NO: 11256 - DNA, 20 bp, Artificial Sequence
  Description of Artificial Sequence: Synthetic oligonucleotide
tggagcattggatttgtaag

SEQ ID NO: 11257 - DNA, 20 bp, Artificial Sequence
  Description of Artificial Sequence: Synthetic oligonucleotide
ggagcattggatttgtaaga

SEQ ID NO: 11258 - DNA, 20 bp, Artificial Sequence
  Description of Artificial Sequence: Synthetic oligonucleotide
gagcattggatttgtaagat

SEQ ID NO: 11259 - DNA, 20 bp, Artificial Sequence
  Description of Artificial Sequence: Synthetic oligonucleotide
agcattggatttgtaagata

SEQ ID NO: 11260 - DNA, 20 bp, Artificial Sequence
  Description of Artificial Sequence: Synthetic oligonucleotide
gcattggatttgtaagatac

SEQ ID NO: 11261 - DNA, 20 bp, Artificial Sequence
  Description of Artificial Sequence: Synthetic oligonucleotide
cattggatttgtaagataca

SEQ ID NO: 11262 - DNA, 20 bp, Artificial Sequence
  Description of Artificial Sequence: Synthetic oligonucleotide
attggatttgtaagatacaa

SEQ ID NO: 11263 - DNA, 20 bp, Artificial Sequence
  Description of Artificial Sequence: Synthetic oligonucleotide
ttggatttgtaagatacaag

SEQ ID NO: 11264 - DNA, 20 bp, Artificial Sequence
  Description of Artificial Sequence: Synthetic oligonucleotide
tggatttgtaagatacaaga

SEQ ID NO: 11265 - DNA, 20 bp, Artificial Sequence
  Description of Artificial Sequence: Synthetic oligonucleotide
ggatttgtaagatacaagag

SEQ ID NO: 11266 - DNA, 20 bp, Artificial Sequence
  Description of Artificial Sequence: Synthetic oligonucleotide
gatttgtaagatacaagagt

SEQ ID NO: 11267 - DNA, 20 bp, Artificial Sequence
  Description of Artificial Sequence: Synthetic oligonucleotide
atttgtaagatacaagagtg

SEQ ID NO: 11268 - DNA, 20 bp, Artificial Sequence
  Description of Artificial Sequence: Synthetic oligonucleotide
tttgtaagatacaagagtgt

SEQ ID NO: 11269 - DNA, 20 bp, Artificial Sequence
  Description of Artificial Sequence: Synthetic oligonucleotide
ttgtaagatacaagagtgtt

SEQ ID NO: 11270 - DNA, 20 bp, Artificial Sequence
  Description of Artificial Sequence: Synthetic oligonucleotide
tgtaagatacaagagtgttt

SEQ ID NO: 11271 - DNA, 20 bp, Artificial Sequence
  Description of Artificial Sequence: Synthetic oligonucleotide
gtaagatacaagagtgtttc

SEQ ID NO: 11272 - DNA, 20 bp, Artificial Sequence
  Description of Artificial Sequence: Synthetic oligonucleotide
taagatacaagagtgtttct

SEQ ID NO: 11273 - DNA, 20 bp, Artificial Sequence
  Description of Artificial Sequence: Synthetic oligonucleotide
aagatacaagagtgtttctg

SEQ ID NO: 11274 - DNA, 20 bp, Artificial Sequence
  Description of Artificial Sequence: Synthetic oligonucleotide
agatacaagagtgtttctgg

SEQ ID NO: 11275 - DNA, 20 bp, Artificial Sequence
  Description of Artificial Sequence: Synthetic oligonucleotide
gatacaagagtgtttctggt

SEQ ID NO: 11276 - DNA, 20 bp, Artificial Sequence
  Description of Artificial Sequence: Synthetic oligonucleotide
atacaagagtgtttctggtc

SEQ ID NO: 11277 - DNA, 20 bp, Artificial Sequence
  Description of Artificial Sequence: Synthetic oligonucleotide
tacaagagtgtttctggtct

SEQ ID NO: 11278 - DNA, 20 bp, Artificial Sequence
  Description of Artificial Sequence: Synthetic oligonucleotide
acaagagtgtttctggtctg

SEQ ID NO: 11279 - DNA, 20 bp, Artificial Sequence
  Description of Artificial Sequence: Synthetic oligonucleotide
caagagtgtttctggtctgg

SEQ ID NO: 11280 - DNA, 20 bp, Artificial Sequence
  Description of Artificial Sequence: Synthetic oligonucleotide
aagagtgtttctggtctggg

SEQ ID NO: 11281 - DNA, 20 bp, Artificial Sequence
  Description of Artificial Sequence: Synthetic oligonucleotide
agagtgtttctggtctggga

SEQ ID NO: 11282 - DNA, 20 bp, Artificial Sequence
  Description of Artificial Sequence: Synthetic oligonucleotide
gagtgtttctggtctgggag

SEQ ID NO: 11283 - DNA, 20 bp, Artificial Sequence
  Description of Artificial Sequence: Synthetic oligonucleotide
agtgtttctggtctgggagc

SEQ ID NO: 11284 - DNA, 20 bp, Artificial Sequence
  Description of Artificial Sequence: Synthetic oligonucleotide
gtgtttctggtctgggagct

SEQ ID NO: 11285 - DNA, 20 bp, Artificial Sequence
  Description of Artificial Sequence: Synthetic oligonucleotide
tgtttctggtctgggagctg

SEQ ID NO: 11286 - DNA, 20 bp, Artificial Sequence
  Description of Artificial Sequence: Synthetic oligonucleotide
gtttctggtctgggagctgg

SEQ ID NO: 11287 - DNA, 20 bp, Artificial Sequence
  Description of Artificial Sequence: Synthetic oligonucleotide
tttctggtctgggagctggg

SEQ ID NO: 11288 - DNA, 20 bp, Artificial Sequence
  Description of Artificial Sequence: Synthetic oligonucleotide
ttctggtctgggagctgggg

SEQ ID NO: 11289 - DNA, 20 bp, Artificial Sequence
  Description of Artificial Sequence: Synthetic oligonucleotide
tctggtctgggagctggggg

SEQ ID NO: 11290 - DNA, 20 bp, Artificial Sequence
  Description of Artificial Sequence: Synthetic oligonucleotide
ctggtctgggagctgggggt

SEQ ID NO: 11291 - DNA, 20 bp, Artificial Sequence
  Description of Artificial Sequence: Synthetic oligonucleotide
tggtctgggagctgggggtt

SEQ ID NO: 11292 - DNA, 20 bp, Artificial Sequence
  Description of Artificial Sequence: Synthetic oligonucleotide
ggtctgggagctgggggttc

SEQ ID NO: 11293 - DNA, 20 bp, Artificial Sequence
  Description of Artificial Sequence: Synthetic oligonucleotide
gtctgggagctgggggttcc

SEQ ID NO: 11294 - DNA, 20 bp, Artificial Sequence
  Description of Artificial Sequence: Synthetic oligonucleotide
tctgggagctgggggttccc

SEQ ID NO: 11295 - DNA, 20 bp, Artificial Sequence
  Description of Artificial Sequence: Synthetic oligonucleotide
ctgggagctgggggttccca

SEQ ID NO: 11296 - DNA, 20 bp, Artificial Sequence
  Description of Artificial Sequence: Synthetic oligonucleotide
tgggagctgggggttcccag

SEQ ID NO: 11297 - DNA, 20 bp, Artificial Sequence
  Description of Artificial Sequence: Synthetic oligonucleotide
gggagctgggggttcccagc

SEQ ID NO: 11298 - DNA, 20 bp, Artificial Sequence
  Description of Artificial Sequence: Synthetic oligonucleotide
ggagctgggggttcccagcc

SEQ ID NO: 11299 - DNA, 20 bp, Artificial Sequence
  Description of Artificial Sequence: Synthetic oligonucleotide
gagctgggggttcccagccc

SEQ ID NO: 11300 - DNA, 20 bp, Artificial Sequence
  Description of Artificial Sequence: Synthetic oligonucleotide
agctgggggttcccagccct

SEQ ID NO: 11301 - DNA, 20 bp, Artificial Sequence
  Description of Artificial Sequence: Synthetic oligonucleotide
gctgggggttcccagcccta

SEQ ID NO: 11302 - DNA, 20 bp, Artificial Sequence
  Description of Artificial Sequence: Synthetic oligonucleotide
ctgggggttcccagccctaa

SEQ ID NO: 11303 - DNA, 20 bp, Artificial Sequence
  Description of Artificial Sequence: Synthetic oligonucleotide
tgggggttcccagccctaat

SEQ ID NO: 11304 - DNA, 20 bp, Artificial Sequence
  Description of Artificial Sequence: Synthetic oligonucleotide
gggggttcccagccctaatt

SEQ ID NO: 11305 - DNA, 20 bp, Artificial Sequence
  Description of Artificial Sequence: Synthetic oligonucleotide
ggggttcccagccctaattc

SEQ ID NO: 11306 - DNA, 20 bp, Artificial Sequence
  Description of Artificial Sequence: Synthetic oligonucleotide
gggttcccagccctaattcc

SEQ ID NO: 11307 - DNA, 20 bp, Artificial Sequence
  Description of Artificial Sequence: Synthetic oligonucleotide
ggttcccagccctaattccc

SEQ ID NO: 11308 - DNA, 20 bp, Artificial Sequence
  Description of Artificial Sequence: Synthetic oligonucleotide
gttcccagccctaattccca

SEQ ID NO: 11309 - DNA, 20 bp, Artificial Sequence
  Description of Artificial Sequence: Synthetic oligonucleotide
ttcccagccctaattcccac

SEQ ID NO: 11310 - DNA, 20 bp, Artificial Sequence
  Description of Artificial Sequence: Synthetic oligonucleotide
tcccagccctaattcccaca

SEQ ID NO: 11311 - DNA, 20 bp, Artificial Sequence
  Description of Artificial Sequence: Synthetic oligonucleotide
cccagccctaattcccacat

SEQ ID NO: 11312 - DNA, 20 bp, Artificial Sequence
  Description of Artificial Sequence: Synthetic oligonucleotide
ccagccctaattcccacata

SEQ ID NO: 11313 - DNA, 20 bp, Artificial Sequence
  Description of Artificial Sequence: Synthetic oligonucleotide
cagccctaattcccacatac

SEQ ID NO: 11314 - DNA, 20 bp, Artificial Sequence
  Description of Artificial Sequence: Synthetic oligonucleotide
agccctaattcccacatacc

SEQ ID NO: 11315 - DNA, 20 bp, Artificial Sequence
  Description of Artificial Sequence: Synthetic oligonucleotide
gccctaattcccacataccc

SEQ ID NO: 11316 - DNA, 20 bp, Artificial Sequence
  Description of Artificial Sequence: Synthetic oligonucleotide
ccctaattcccacatacccc

SEQ ID NO: 11317 - DNA, 20 bp, Artificial Sequence
  Description of Artificial Sequence: Synthetic oligonucleotide
cctaattcccacatacccca

SEQ ID NO: 11318 - DNA, 20 bp, Artificial Sequence
  Description of Artificial Sequence: Synthetic oligonucleotide
ctaattcccacataccccaa

SEQ ID NO: 11319 - DNA, 20 bp, Artificial Sequence
  Description of Artificial Sequence: Synthetic oligonucleotide
taattcccacataccccaag

SEQ ID NO: 11320 - DNA, 20 bp, Artificial Sequence
  Description of Artificial Sequence: Synthetic oligonucleotide
aattcccacataccccaaga

SEQ ID NO: 11321 - DNA, 20 bp, Artificial Sequence
  Description of Artificial Sequence: Synthetic oligonucleotide
attcccacataccccaagac

SEQ ID NO: 11322 - DNA, 20 bp, Artificial Sequence
  Description of Artificial Sequence: Synthetic oligonucleotide
ttcccacataccccaagaca

SEQ ID NO: 11323 - DNA, 20 bp, Artificial Sequence
  Description of Artificial Sequence: Synthetic oligonucleotide
tcccacataccccaagacat

SEQ ID NO: 11324 - DNA, 20 bp, Artificial Sequence
  Description of Artificial Sequence: Synthetic oligonucleotide
cccacataccccaagacatt

SEQ ID NO: 11325 - DNA, 20 bp, Artificial Sequence
  Description of Artificial Sequence: Synthetic oligonucleotide
ccacataccccaagacattg

SEQ ID NO: 11326 - DNA, 20 bp, Artificial Sequence
  Description of Artificial Sequence: Synthetic oligonucleotide
cacataccccaagacattgt

SEQ ID NO: 11327 - DNA, 20 bp, Artificial Sequence
  Description of Artificial Sequence: Synthetic oligonucleotide
acataccccaagacattgtg

SEQ ID NO: 11328 - DNA, 20 bp, Artificial Sequence
  Description of Artificial Sequence: Synthetic oligonucleotide
cataccccaagacattgtgg

SEQ ID NO: 11329 - DNA, 20 bp, Artificial Sequence
  Description of Artificial Sequence: Synthetic oligonucleotide
ataccccaagacattgtgga

SEQ ID NO: 11330 - DNA, 20 bp, Artificial Sequence
  Description of Artificial Sequence: Synthetic oligonucleotide
taccccaagacattgtggag

SEQ ID NO: 11331 - DNA, 20 bp, Artificial Sequence
  Description of Artificial Sequence: Synthetic oligonucleotide
accccaagacattgtggagg

SEQ ID NO: 11332 - DNA, 20 bp, Artificial Sequence
  Description of Artificial Sequence: Synthetic oligonucleotide
ccccaagacattgtggaggg

SEQ ID NO: 11333 - DNA, 20 bp, Artificial Sequence
  Description of Artificial Sequence: Synthetic oligonucleotide
cccaagacattgtggagggc

SEQ ID NO: 11334 - DNA, 20 bp, Artificial Sequence
  Description of Artificial Sequence: Synthetic oligonucleotide
ccaagacattgtggagggcc

SEQ ID NO: 11335 - DNA, 20 bp, Artificial Sequence
  Description of Artificial Sequence: Synthetic oligonucleotide
caagacattgtggagggccc

SEQ ID NO: 11336 - DNA, 20 bp, Artificial Sequence
  Description of Artificial Sequence: Synthetic oligonucleotide
aagacattgtggagggccca

SEQ ID NO: 11337 - DNA, 20 bp, Artificial Sequence
  Description of Artificial Sequence: Synthetic oligonucleotide
agacattgtggagggcccaa

SEQ ID NO: 11338 - DNA, 20 bp, Artificial Sequence
  Description of Artificial Sequence: Synthetic oligonucleotide
gacattgtggagggcccaaa

SEQ ID NO: 11339 - DNA, 20 bp, Artificial Sequence
  Description of Artificial Sequence: Synthetic oligonucleotide
acattgtggagggcccaaat

SEQ ID NO: 11340 - DNA, 20 bp, Artificial Sequence
  Description of Artificial Sequence: Synthetic oligonucleotide
cattgtggagggcccaaatc

SEQ ID NO: 11341 - DNA, 20 bp, Artificial Sequence
  Description of Artificial Sequence: Synthetic oligonucleotide
attgtggagggcccaaatct

SEQ ID NO: 11342 - DNA, 20 bp, Artificial Sequence
  Description of Artificial Sequence: Synthetic oligonucleotide
ttgtggagggcccaaatcta

SEQ ID NO: 11343 - DNA, 20 bp, Artificial Sequence
  Description of Artificial Sequence: Synthetic oligonucleotide
tgtggagggcccaaatctac

SEQ ID NO: 11344 - DNA, 20 bp, Artificial Sequence
  Description of Artificial Sequence: Synthetic oligonucleotide
gtggagggcccaaatctaca

SEQ ID NO: 11345 - DNA, 20 bp, Artificial Sequence
  Description of Artificial Sequence: Synthetic oligonucleotide
tggagggcccaaatctacaa

SEQ ID NO: 11346 - DNA, 20 bp, Artificial Sequence
  Description of Artificial Sequence: Synthetic oligonucleotide
ggagggcccaaatctacaaa

SEQ ID NO: 11347 - DNA, 20 bp, Artificial Sequence
  Description of Artificial Sequence: Synthetic oligonucleotide
gagggcccaaatctacaaac

SEQ ID NO: 11348 - DNA, 20 bp, Artificial Sequence
  Description of Artificial Sequence: Synthetic oligonucleotide
agggcccaaatctacaaaca

SEQ ID NO: 11349 - DNA, 20 bp, Artificial Sequence
  Description of Artificial Sequence: Synthetic oligonucleotide
gggcccaaatctacaaacac

SEQ ID NO: 11350 - DNA, 20 bp, Artificial Sequence
  Description of Artificial Sequence: Synthetic oligonucleotide
ggcccaaatctacaaacact

SEQ ID NO: 11351 - DNA, 20 bp, Artificial Sequence
  Description of Artificial Sequence: Synthetic oligonucleotide
gcccaaatctacaaacacta

SEQ ID NO: 11352 - DNA, 20 bp, Artificial Sequence
  Description of Artificial Sequence: Synthetic oligonucleotide
cccaaatctacaaacactac

SEQ ID NO: 11353 - DNA, 20 bp, Artificial Sequence
  Description of Artificial Sequence: Synthetic oligonucleotide
ccaaatctacaaacactact

SEQ ID NO: 11354 - DNA, 20 bp, Artificial Sequence
  Description of Artificial Sequence: Synthetic oligonucleotide
caaatctacaaacactacta

SEQ ID NO: 11355 - DNA, 20 bp, Artificial Sequence
  Description of Artificial Sequence: Synthetic oligonucleotide
aaatctacaaacactactac

SEQ ID NO: 11356 - DNA, 20 bp, Artificial Sequence
  Description of Artificial Sequence: Synthetic oligonucleotide
aatctacaaacactactacc

SEQ ID NO: 11357 - DNA, 20 bp, Artificial Sequence
  Description of Artificial Sequence: Synthetic oligonucleotide
atctacaaacactactacct

SEQ ID NO: 11358 - DNA, 20 bp, Artificial Sequence
  Description of Artificial Sequence: Synthetic oligonucleotide
tctacaaacactactacctg

SEQ ID NO: 11359 - DNA, 20 bp, Artificial Sequence
  Description of Artificial Sequence: Synthetic oligonucleotide
ctacaaacactactacctgg

SEQ ID NO: 11360 - DNA, 20 bp, Artificial Sequence
  Description of Artificial Sequence: Synthetic oligonucleotide
tacaaacactactacctggc

SEQ ID NO: 11361 - DNA, 20 bp, Artificial Sequence
  Description of Artificial Sequence: Synthetic oligonucleotide
acaaacactactacctggca

SEQ ID NO: 11362 - DNA, 20 bp, Artificial Sequence
  Description of Artificial Sequence: Synthetic oligonucleotide
caaacactactacctggcac

SEQ ID NO: 11363 - DNA, 20 bp, Artificial Sequence
  Description of Artificial Sequence: Synthetic oligonucleotide
aaacactactacctggcacc

SEQ ID NO: 11364 - DNA, 20 bp, Artificial Sequence
  Description of Artificial Sequence: Synthetic oligonucleotide
aacactactacctggcaccc

SEQ ID NO: 11365 - DNA, 20 bp, Artificial Sequence
  Description of Artificial Sequence: Synthetic oligonucleotide
acactactacctggcacccc

SEQ ID NO: 11366 - DNA, 20 bp, Artificial Sequence
  Description of Artificial Sequence: Synthetic oligonucleotide
cactactacctggcaccccc

SEQ ID NO: 11367 - DNA, 20 bp, Artificial Sequence
  Description of Artificial Sequence: Synthetic oligonucleotide
actactacctggcaccccct

SEQ ID NO: 11368 - DNA, 20 bp, Artificial Sequence
  Description of Artificial Sequence: Synthetic oligonucleotide
ctactacctggcaccccctc

SEQ ID NO: 11369 - DNA, 20 bp, Artificial Sequence
  Description of Artificial Sequence: Synthetic oligonucleotide
tactacctggcaccccctcc

SEQ ID NO: 11370 - DNA, 20 bp, Artificial Sequence
  Description of Artificial Sequence: Synthetic oligonucleotide
actacctggcaccccctcct

SEQ ID NO: 11371 - DNA, 20 bp, Artificial Sequence
  Description of Artificial Sequence: Synthetic oligonucleotide
ctacctggcaccccctcctc

SEQ ID NO: 11372 - DNA, 20 bp, Artificial Sequence
  Description of Artificial Sequence: Synthetic oligonucleotide
tacctggcaccccctcctcc

SEQ ID NO: 11373 - DNA, 20 bp, Artificial Sequence
  Description of Artificial Sequence: Synthetic oligonucleotide
acctggcaccccctcctcca

SEQ ID NO: 11374 - DNA, 20 bp, Artificial Sequence
  Description of Artificial Sequence: Synthetic oligonucleotide
cctggcaccccctcctccat

SEQ ID NO: 11375 - DNA, 20 bp, Artificial Sequence
  Description of Artificial Sequence: Synthetic oligonucleotide
ctggcaccccctcctccatg

SEQ ID NO: 11376 - DNA, 20 bp, Artificial Sequence
  Description of Artificial Sequence: Synthetic oligonucleotide
tggcaccccctcctccatga

SEQ ID NO: 11377 - DNA, 20 bp, Artificial Sequence
  Description of Artificial Sequence: Synthetic oligonucleotide
ggcaccccctcctccatgac

SEQ ID NO: 11378 - DNA, 20 bp, Artificial Sequence
  Description of Artificial Sequence: Synthetic oligonucleotide
gcaccccctcctccatgaca

SEQ ID NO: 11379 - DNA, 20 bp, Artificial Sequence
  Description of Artificial Sequence: Synthetic oligonucleotide
caccccctcctccatgacac

SEQ ID NO: 11380 - DNA, 20 bp, Artificial Sequence
  Description of Artificial Sequence: Synthetic oligonucleotide
accccctcctccatgacacc

SEQ ID NO: 11381 - DNA, 20 bp, Artificial Sequence
  Description of Artificial Sequence: Synthetic oligonucleotide
ccccctcctccatgacaccc

SEQ ID NO: 11382 - DNA, 20 bp, Artificial Sequence
  Description of Artificial Sequence: Synthetic oligonucleotide
cccctcctccatgacaccct

SEQ ID NO: 11383 - DNA, 20 bp, Artificial Sequence
  Description of Artificial Sequence: Synthetic oligonucleotide
ccctcctccatgacaccctc

SEQ ID NO: 11384 - DNA, 20 bp, Artificial Sequence
  Description of Artificial Sequence: Synthetic oligonucleotide
cctcctccatgacaccctcc

SEQ ID NO: 11385 - DNA, 20 bp, Artificial Sequence
  Description of Artificial Sequence: Synthetic oligonucleotide
ctcctccatgacaccctccc

SEQ ID NO: 11386 - DNA, 20 bp, Artificial Sequence
  Description of Artificial Sequence: Synthetic oligonucleotide
tcctccatgacaccctcccc

SEQ ID NO: 11387 - DNA, 20 bp, Artificial Sequence
  Description of Artificial Sequence: Synthetic oligonucleotide
cctccatgacaccctcccct

SEQ ID NO: 11388 - DNA, 20 bp, Artificial Sequence
  Description of Artificial Sequence: Synthetic oligonucleotide
ctccatgacaccctccccta

SEQ ID NO: 11389 - DNA, 20 bp, Artificial Sequence
  Description of Artificial Sequence: Synthetic oligonucleotide
tccatgacaccctcccctag

SEQ ID NO: 11390 - DNA, 20 bp, Artificial Sequence
  Description of Artificial Sequence: Synthetic oligonucleotide
ccatgacaccctcccctaga

SEQ ID NO: 11391 - DNA, 20 bp, Artificial Sequence
  Description of Artificial Sequence: Synthetic oligonucleotide
catgacaccctcccctagaa

SEQ ID NO: 11392 - DNA, 20 bp, Artificial Sequence
  Description of Artificial Sequence: Synthetic oligonucleotide
atgacaccctcccctagaag

SEQ ID NO: 11393 - DNA, 20 bp, Artificial Sequence
  Description of Artificial Sequence: Synthetic oligonucleotide
tgacaccctcccctagaagg

SEQ ID NO: 11394 - DNA, 20 bp, Artificial Sequence
  Description of Artificial Sequence: Synthetic oligonucleotide
gacaccctcccctagaaggt

SEQ ID NO: 11395 - DNA, 20 bp, Artificial Sequence
  Description of Artificial Sequence: Synthetic oligonucleotide
acaccctcccctagaaggtt

SEQ ID NO: 11396 - DNA, 20 bp, Artificial Sequence
  Description of Artificial Sequence: Synthetic oligonucleotide
caccctcccctagaaggttc

SEQ ID NO: 11397 - DNA, 20 bp, Artificial Sequence
  Description of Artificial Sequence: Synthetic oligonucleotide
accctcccctagaaggttct

SEQ ID NO: 11398 - DNA, 20 bp, Artificial Sequence
  Description of Artificial Sequence: Synthetic oligonucleotide
ccctcccctagaaggttcta

SEQ ID NO: 11399 - DNA, 20 bp, Artificial Sequence
  Description of Artificial Sequence: Synthetic oligonucleotide
cctcccctagaaggttctaa

SEQ ID NO: 11400 - DNA, 20 bp, Artificial Sequence
  Description of Artificial Sequence: Synthetic oligonucleotide
ctcccctagaaggttctaac

SEQ ID NO: 11401 - DNA, 20 bp, Artificial Sequence
  Description of Artificial Sequence: Synthetic oligonucleotide
tcccctagaaggttctaacc

SEQ ID NO: 11402 - DNA, 20 bp, Artificial Sequence
  Description of Artificial Sequence: Synthetic oligonucleotide
cccctagaaggttctaacct

SEQ ID NO: 11403 - DNA, 20 bp, Artificial Sequence
  Description of Artificial Sequence: Synthetic oligonucleotide
ccctagaaggttctaacctt

SEQ ID NO: 11404 - DNA, 20 bp, Artificial Sequence
  Description of Artificial Sequence: Synthetic oligonucleotide
cctagaaggttctaaccttc

SEQ ID NO: 11405 - DNA, 20 bp, Artificial Sequence
  Description of Artificial Sequence: Synthetic oligonucleotide
ctagaaggttctaaccttca

SEQ ID NO: 11406 - DNA, 20 bp, Artificial Sequence
  Description of Artificial Sequence: Synthetic oligonucleotide
tagaaggttctaaccttcag

SEQ ID NO: 11407 - DNA, 20 bp, Artificial Sequence
  Description of Artificial Sequence: Synthetic oligonucleotide
agaaggttctaaccttcagg

SEQ ID NO: 11408 - DNA, 20 bp, Artificial Sequence
  Description of Artificial Sequence: Synthetic oligonucleotide
gaaggttctaaccttcagga

SEQ ID NO: 11409 - DNA, 20 bp, Artificial Sequence
  Description of Artificial Sequence: Synthetic oligonucleotide
aaggttctaaccttcaggat

SEQ ID NO: 11410 - DNA, 20 bp, Artificial Sequence
  Description of Artificial Sequence: Synthetic oligonucleotide
aggttctaaccttcaggatg

SEQ ID NO: 11411 - DNA, 20 bp, Artificial Sequence
  Description of Artificial Sequence: Synthetic oligonucleotide
ggttctaaccttcaggatgg

SEQ ID NO: 11412 - DNA, 20 bp, Artificial Sequence
  Description of Artificial Sequence: Synthetic oligonucleotide
gttctaaccttcaggatggc

SEQ ID NO: 11413 - DNA, 20 bp, Artificial Sequence
  Description of Artificial Sequence: Synthetic oligonucleotide
ttctaaccttcaggatggca

SEQ ID NO: 11414 - DNA, 20 bp, Artificial Sequence
  Description of Artificial Sequence: Synthetic oligonucleotide
tctaaccttcaggatggcac

SEQ ID NO: 11415 - DNA, 20 bp, Artificial Sequence
  Description of Artificial Sequence: Synthetic oligonucleotide
ctaaccttcaggatggcacc

SEQ ID NO: 11416 - DNA, 20 bp, Artificial Sequence
  Description of Artificial Sequence: Synthetic oligonucleotide
taaccttcaggatggcaccc

SEQ ID NO: 11417 - DNA, 20 bp, Artificial Sequence
  Description of Artificial Sequence: Synthetic oligonucleotide
aaccttcaggatggcacccc

SEQ ID NO: 11418 - DNA, 20 bp, Artificial Sequence
  Description of Artificial Sequence: Synthetic oligonucleotide
accttcaggatggcaccccg

SEQ ID NO: 11419 - DNA, 20 bp, Artificial Sequence
  Description of Artificial Sequence: Synthetic oligonucleotide
ccttcaggatggcaccccga

SEQ ID NO: 11420 - DNA, 20 bp, Artificial Sequence
  Description of Artificial Sequence: Synthetic oligonucleotide
cttcaggatggcaccccgaa

SEQ ID NO: 11421 - DNA, 20 bp, Artificial Sequence
  Description of Artificial Sequence: Synthetic oligonucleotide
ttcaggatggcaccccgaac

SEQ ID NO: 11422 - DNA, 20 bp, Artificial Sequence
  Description of Artificial Sequence: Synthetic oligonucleotide
tcaggatggcaccccgaacc

SEQ ID NO: 11423 - DNA, 20 bp, Artificial Sequence
  Description of Artificial Sequence: Synthetic oligonucleotide
caggatggcaccccgaaccc

SEQ ID NO: 11424 - DNA, 20 bp, Artificial Sequence
  Description of Artificial Sequence: Synthetic oligonucleotide
aggatggcaccccgaacccc

SEQ ID NO: 11425 - DNA, 20 bp, Artificial Sequence
  Description of Artificial Sequence: Synthetic oligonucleotide
ggatggcaccccgaacccca

SEQ ID NO: 11426 - DNA, 20 bp, Artificial Sequence
  Description of Artificial Sequence: Synthetic oligonucleotide
gatggcaccccgaaccccat

SEQ ID NO: 11427 - DNA, 20 bp, Artificial Sequence
  Description of Artificial Sequence: Synthetic oligonucleotide
atggcaccccgaaccccatt

SEQ ID NO: 11428 - DNA, 20 bp, Artificial Sequence
  Description of Artificial Sequence: Synthetic oligonucleotide
tggcaccccgaaccccattt

SEQ ID NO: 11429 - DNA, 20 bp, Artificial Sequence
  Description of Artificial Sequence: Synthetic oligonucleotide
ggcaccccgaaccccatttc

SEQ ID NO: 11430 - DNA, 20 bp, Artificial Sequence
  Description of Artificial Sequence: Synthetic oligonucleotide
gcaccccgaaccccatttct

SEQ ID NO: 11431 - DNA, 20 bp, Artificial Sequence
  Description of Artificial Sequence: Synthetic oligonucleotide
caccccgaaccccatttcta

SEQ ID NO: 11432 - DNA, 20 bp, Artificial Sequence
  Description of Artificial Sequence: Synthetic oligonucleotide
accccgaaccccatttctac

SEQ ID NO: 11433 - DNA, 20 bp, Artificial Sequence
  Description of Artificial Sequence: Synthetic oligonucleotide
ccccgaaccccatttctacc

SEQ ID NO: 11434 - DNA, 20 bp, Artificial Sequence
  Description of Artificial Sequence: Synthetic oligonucleotide
cccgaaccccatttctacct

SEQ ID NO: 11435 - DNA, 20 bp, Artificial Sequence
  Description of Artificial Sequence: Synthetic oligonucleotide
ccgaaccccatttctacctt

SEQ ID NO: 11436 - DNA, 20 bp, Artificial Sequence
  Description of Artificial Sequence: Synthetic oligonucleotide
cgaaccccatttctaccttc

SEQ ID NO: 11437 - DNA, 20 bp, Artificial Sequence
  Description of Artificial Sequence: Synthetic oligonucleotide
gaaccccatttctaccttct

SEQ ID NO: 11438 - DNA, 20 bp, Artificial Sequence
  Description of Artificial Sequence: Synthetic oligonucleotide
aaccccatttctaccttctc

SEQ ID NO: 11439 - DNA, 20 bp, Artificial Sequence
  Description of Artificial Sequence: Synthetic oligonucleotide
accccatttctaccttctcc

SEQ ID NO: 11440 - DNA, 20 bp, Artificial Sequence
  Description of Artificial Sequence: Synthetic oligonucleotide
ccccatttctaccttctcca

SEQ ID NO: 11441 - DNA, 20 bp, Artificial Sequence
  Description of Artificial Sequence: Synthetic oligonucleotide
cccatttctaccttctccag

SEQ ID NO: 11442 - DNA, 20 bp, Artificial Sequence
  Description of Artificial Sequence: Synthetic oligonucleotide
ccatttctaccttctccagc

SEQ ID NO: 11443 - DNA, 20 bp, Artificial Sequence
  Description of Artificial Sequence: Synthetic oligonucleotide
catttctaccttctccagca

SEQ ID NO: 11444 - DNA, 20 bp, Artificial Sequence
  Description of Artificial Sequence: Synthetic oligonucleotide
atttctaccttctccagcac

SEQ ID NO: 11445 - DNA, 20 bp, Artificial Sequence
  Description of Artificial Sequence: Synthetic oligonucleotide
tttctaccttctccagcacc

SEQ ID NO: 11446 - DNA, 20 bp, Artificial Sequence
  Description of Artificial Sequence: Synthetic oligonucleotide
ttctaccttctccagcaccc

SEQ ID NO: 11447 - DNA, 20 bp, Artificial Sequence
  Description of Artificial Sequence: Synthetic oligonucleotide
tctaccttctccagcacccc

SEQ ID NO: 11448 - DNA, 20 bp, Artificial Sequence
  Description of Artificial Sequence: Synthetic oligonucleotide
ctaccttctccagcacccct

SEQ ID NO: 11449 - DNA, 20 bp, Artificial Sequence
  Description of Artificial Sequence: Synthetic oligonucleotide
taccttctccagcacccctg

SEQ ID NO: 11450 - DNA, 20 bp, Artificial Sequence
  Description of Artificial Sequence: Synthetic oligonucleotide
accttctccagcacccctgc

SEQ ID NO: 11451 - DNA, 20 bp, Artificial Sequence
  Description of Artificial Sequence: Synthetic oligonucleotide
ccttctccagcacccctgca

SEQ ID NO: 11452 - DNA, 20 bp, Artificial Sequence
  Description of Artificial Sequence: Synthetic oligonucleotide
cttctccagcacccctgcag

SEQ ID NO: 11453 - DNA, 20 bp, Artificial Sequence
  Description of Artificial Sequence: Synthetic oligonucleotide
ttctccagcacccctgcagc

SEQ ID NO: 11454 - DNA, 20 bp, Artificial Sequence
  Description of Artificial Sequence: Synthetic oligonucleotide
tctccagcacccctgcagct

SEQ ID NO: 11455 - DNA, 20 bp, Artificial Sequence
  Description of Artificial Sequence: Synthetic oligonucleotide
ctccagcacccctgcagctc

SEQ ID NO: 11456 - DNA, 20 bp, Artificial Sequence
  Description of Artificial Sequence: Synthetic oligonucleotide
tccagcacccctgcagctca

SEQ ID NO: 11457 - DNA, 20 bp, Artificial Sequence
  Description of Artificial Sequence: Synthetic oligonucleotide
ccagcacccctgcagctcaa

SEQ ID NO: 11458 - DNA, 20 bp, Artificial Sequence
  Description of Artificial Sequence: Synthetic oligonucleotide
cagcacccctgcagctcaag

SEQ ID NO: 11459 - DNA, 20 bp, Artificial Sequence
  Description of Artificial Sequence: Synthetic oligonucleotide
agcacccctgcagctcaagt

SEQ ID NO: 11460 - DNA, 20 bp, Artificial Sequence
  Description of Artificial Sequence: Synthetic oligonucleotide
gcacccctgcagctcaagtc

SEQ ID NO: 11461 - DNA, 20 bp, Artificial Sequence
  Description of Artificial Sequence: Synthetic oligonucleotide
cacccctgcagctcaagtcc

SEQ ID NO: 11462 - DNA, 20 bp, Artificial Sequence
  Description of Artificial Sequence: Synthetic oligonucleotide
acccctgcagctcaagtccc

SEQ ID NO: 11463 - DNA, 20 bp, Artificial Sequence
  Description of Artificial Sequence: Synthetic oligonucleotide
cccctgcagctcaagtccct

SEQ ID NO: 11464 - DNA, 20 bp, Artificial Sequence
  Description of Artificial Sequence: Synthetic oligonucleotide
ccctgcagctcaagtccctc

SEQ ID NO: 11465 - DNA, 20 bp, Artificial Sequence
  Description of Artificial Sequence: Synthetic oligonucleotide
cctgcagctcaagtccctca

SEQ ID NO: 11466 - DNA, 20 bp, Artificial Sequence
  Description of Artificial Sequence: Synthetic oligonucleotide
ctgcagctcaagtccctcaa

SEQ ID NO: 11467 - DNA, 20 bp, Artificial Sequence
  Description of Artificial Sequence: Synthetic oligonucleotide
tgcagctcaagtccctcaag

SEQ ID NO: 11468 - DNA, 20 bp, Artificial Sequence
  Description of Artificial Sequence: Synthetic oligonucleotide
gcagctcaagtccctcaaga

SEQ ID NO: 11469 - DNA, 20 bp, Artificial Sequence
  Description of Artificial Sequence: Synthetic oligonucleotide
cagctcaagtccctcaagac

SEQ ID NO: 11470 - DNA, 20 bp, Artificial Sequence
  Description of Artificial Sequence: Synthetic oligonucleotide
agctcaagtccctcaagacc

SEQ ID NO: 11471 - DNA, 20 bp, Artificial Sequence
  Description of Artificial Sequence: Synthetic oligonucleotide
gctcaagtccctcaagacct

SEQ ID NO: 11472 - DNA, 20 bp, Artificial Sequence
  Description of Artificial Sequence: Synthetic oligonucleotide
ctcaagtccctcaagacctc

SEQ ID NO: 11473 - DNA, 20 bp, Artificial Sequence
  Description of Artificial Sequence: Synthetic oligonucleotide
tcaagtccctcaagacctct

SEQ ID NO: 11474 - DNA, 20 bp, Artificial Sequence
  Description of Artificial Sequence: Synthetic oligonucleotide
caagtccctcaagacctctt

SEQ ID NO: 11475 - DNA, 20 bp, Artificial Sequence
  Description of Artificial Sequence: Synthetic oligonucleotide
aagtccctcaagacctcttt

SEQ ID NO: 11476 - DNA, 20 bp, Artificial Sequence
  Description of Artificial Sequence: Synthetic oligonucleotide
agtccctcaagacctctttc

SEQ ID NO: 11477 - DNA, 20 bp, Artificial Sequence
  Description of Artificial Sequence: Synthetic oligonucleotide
gtccctcaagacctctttct

SEQ ID NO: 11478 - DNA, 20 bp, Artificial Sequence
  Description of Artificial Sequence: Synthetic oligonucleotide
tccctcaagacctctttctc

SEQ ID NO: 11479 - DNA, 20 bp, Artificial Sequence
  Description of Artificial Sequence: Synthetic oligonucleotide
ccctcaagacctctttctcc

SEQ ID NO: 11480 - DNA, 20 bp, Artificial Sequence
  Description of Artificial Sequence: Synthetic oligonucleotide
cctcaagacctctttctcca

SEQ ID NO: 11481 - DNA, 20 bp, Artificial Sequence
  Description of Artificial Sequence: Synthetic oligonucleotide
ctcaagacctctttctccac

SEQ ID NO: 11482 - DNA, 20 bp, Artificial Sequence
  Description of Artificial Sequence: Synthetic oligonucleotide
tcaagacctctttctccacc

SEQ ID NO: 11483 - DNA, 20 bp, Artificial Sequence
  Description of Artificial Sequence: Synthetic oligonucleotide
caagacctctttctccacct

SEQ ID NO: 11484 - DNA, 20 bp, Artificial Sequence
  Description of Artificial Sequence: Synthetic oligonucleotide
aagacctctttctccacctc

SEQ ID NO: 11485 - DNA, 20 bp, Artificial Sequence
  Description of Artificial Sequence: Synthetic oligonucleotide
agacctctttctccacctct

SEQ ID NO: 11486 - DNA, 20 bp, Artificial Sequence
  Description of Artificial Sequence: Synthetic oligonucleotide
gacctctttctccacctctg

SEQ ID NO: 11487 - DNA, 20 bp, Artificial Sequence
  Description of Artificial Sequence: Synthetic oligonucleotide
acctctttctccacctctgt

SEQ ID NO: 11488 - DNA, 20 bp, Artificial Sequence
  Description of Artificial Sequence: Synthetic oligonucleotide
cctctttctccacctctgtt

SEQ ID NO: 11489 - DNA, 20 bp, Artificial Sequence
  Description of Artificial Sequence: Synthetic oligonucleotide
ctctttctccacctctgttc

SEQ ID NO: 11490 - DNA, 20 bp, Artificial Sequence
  Description of Artificial Sequence: Synthetic oligonucleotide
tctttctccacctctgttcc

SEQ ID NO: 11491 - DNA, 20 bp, Artificial Sequence
  Description of Artificial Sequence: Synthetic oligonucleotide
ctttctccacctctgttcca

SEQ ID NO: 11492 - DNA, 20 bp, Artificial Sequence
  Description of Artificial Sequence: Synthetic oligonucleotide
tttctccacctctgttccaa

SEQ ID NO: 11493 - DNA, 20 bp, Artificial Sequence
  Description of Artificial Sequence: Synthetic oligonucleotide
ttctccacctctgttccaat

SEQ ID NO: 11494 - DNA, 20 bp, Artificial Sequence
  Description of Artificial Sequence: Synthetic oligonucleotide
tctccacctctgttccaatc

SEQ ID NO: 11495 - DNA, 20 bp, Artificial Sequence
  Description of Artificial Sequence: Synthetic oligonucleotide
ctccacctctgttccaatca

SEQ ID NO: 11496 - DNA, 20 bp, Artificial Sequence
  Description of Artificial Sequence: Synthetic oligonucleotide
tccacctctgttccaatcag

SEQ ID NO: 11497 - DNA, 20 bp, Artificial Sequence
  Description of Artificial Sequence: Synthetic oligonucleotide
ccacctctgttccaatcagt

SEQ ID NO: 11498 - DNA, 20 bp, Artificial Sequence
  Description of Artificial Sequence: Synthetic oligonucleotide
cacctctgttccaatcagtg

SEQ ID NO: 11499 - DNA, 20 bp, Artificial Sequence
  Description of Artificial Sequence: Synthetic oligonucleotide
acctctgttccaatcagtga

SEQ ID NO: 11500 - DNA, 20 bp, Artificial Sequence
  Description of Artificial Sequence: Synthetic oligonucleotide
cctctgttccaatcagtgat

SEQ ID NO: 11501 - DNA, 20 bp, Artificial Sequence
  Description of Artificial Sequence: Synthetic oligonucleotide
ctctgttccaatcagtgatc

SEQ ID NO: 11502 - DNA, 20 bp, Artificial Sequence
  Description of Artificial Sequence: Synthetic oligonucleotide
tctgttccaatcagtgatca

SEQ ID NO: 11503 - DNA, 20 bp, Artificial Sequence
  Description of Artificial Sequence: Synthetic oligonucleotide
ctgttccaatcagtgatcag

SEQ ID NO: 11504 - DNA, 20 bp, Artificial Sequence
  Description of Artificial Sequence: Synthetic oligonucleotide
tgttccaatcagtgatcagc

SEQ ID NO: 11505 - DNA, 20 bp, Artificial Sequence
  Description of Artificial Sequence: Synthetic oligonucleotide
gttccaatcagtgatcagca

SEQ ID NO: 11506 - DNA, 20 bp, Artificial Sequence
  Description of Artificial Sequence: Synthetic oligonucleotide
ttccaatcagtgatcagcag

SEQ ID NO: 11507 - DNA, 20 bp, Artificial Sequence
  Description of Artificial Sequence: Synthetic oligonucleotide
tccaatcagtgatcagcagg

SEQ ID NO: 11508 - DNA, 20 bp, Artificial Sequence
  Description of Artificial Sequence: Synthetic oligonucleotide
ccaatcagtgatcagcaggg

SEQ ID NO: 11509 - DNA, 20 bp, Artificial Sequence
  Description of Artificial Sequence: Synthetic oligonucleotide
caatcagtgatcagcagggc

SEQ ID NO: 11510 - DNA, 20 bp, Artificial Sequence
  Description of Artificial Sequence: Synthetic oligonucleotide
aatcagtgatcagcagggct

SEQ ID NO: 11511 - DNA, 20 bp, Artificial Sequence
  Description of Artificial Sequence: Synthetic oligonucleotide
atcagtgatcagcagggctt

SEQ ID NO: 11512 - DNA, 20 bp, Artificial Sequence
  Description of Artificial Sequence: Synthetic oligonucleotide
tcagtgatcagcagggcttc

SEQ ID NO: 11513 - DNA, 20 bp, Artificial Sequence
  Description of Artificial Sequence: Synthetic oligonucleotide
cagtgatcagcagggcttca

SEQ ID NO: 11514 - DNA, 20 bp, Artificial Sequence
  Description of Artificial Sequence: Synthetic oligonucleotide
agtgatcagcagggcttcag

SEQ ID NO: 11515 - DNA, 20 bp, Artificial Sequence
  Description of Artificial Sequence: Synthetic oligonucleotide
gtgatcagcagggcttcagg

SEQ ID NO: 11516 - DNA, 20 bp, Artificial Sequence
  Description of Artificial Sequence: Synthetic oligonucleotide
tgatcagcagggcttcaggg

SEQ ID NO: 11517 - DNA, 20 bp, Artificial Sequence
  Description of Artificial Sequence: Synthetic oligonucleotide
gatcagcagggcttcaggga

SEQ ID NO: 11518 - DNA, 20 bp, Artificial Sequence
  Description of Artificial Sequence: Synthetic oligonucleotide
atcagcagggcttcagggac

SEQ ID NO: 11519 - DNA, 20 bp, Artificial Sequence
  Description of Artificial Sequence: Synthetic oligonucleotide
tcagcagggcttcagggaca

SEQ ID NO: 11520 - DNA, 20 bp, Artificial Sequence
  Description of Artificial Sequence: Synthetic oligonucleotide
cagcagggcttcagggacag

SEQ ID NO: 11521 - DNA, 20 bp, Artificial Sequence
  Description of Artificial Sequence: Synthetic oligonucleotide
agcagggcttcagggacagc

SEQ ID NO: 11522 - DNA, 20 bp, Artificial Sequence
  Description of Artificial Sequence: Synthetic oligonucleotide
gcagggcttcagggacagcc

SEQ ID NO: 11523 - DNA, 20 bp, Artificial Sequence
  Description of Artificial Sequence: Synthetic oligonucleotide
cagggcttcagggacagccc

SEQ ID NO: 11524 - DNA, 20 bp, Artificial Sequence
  Description of Artificial Sequence: Synthetic oligonucleotide
agggcttcagggacagccca

SEQ ID NO: 11525 - DNA, 20 bp, Artificial Sequence
  Description of Artificial Sequence: Synthetic oligonucleotide
gggcttcagggacagcccac

SEQ ID NO: 11526 - DNA, 20 bp, Artificial Sequence
  Description of Artificial Sequence: Synthetic oligonucleotide
ggcttcagggacagcccact

SEQ ID NO: 11527 - DNA, 20 bp, Artificial Sequence
  Description of Artificial Sequence: Synthetic oligonucleotide
gcttcagggacagcccactg

SEQ ID NO: 11528 - DNA, 20 bp, Artificial Sequence
  Description of Artificial Sequence: Synthetic oligonucleotide
cttcagggacagcccactgg

SEQ ID NO: 11529 - DNA, 20 bp, Artificial Sequence
  Description of Artificial Sequence: Synthetic oligonucleotide
ttcagggacagcccactggc

SEQ ID NO: 11530 - DNA, 20 bp, Artificial Sequence
  Description of Artificial Sequence: Synthetic oligonucleotide
tcagggacagcccactggct

SEQ ID NO: 11531 - DNA, 20 bp, Artificial Sequence
  Description of Artificial Sequence: Synthetic oligonucleotide
cagggacagcccactggctt

SEQ ID NO: 11532 - DNA, 20 bp, Artificial Sequence
  Description of Artificial Sequence: Synthetic oligonucleotide
agggacagcccactggcttg

SEQ ID NO: 11533 - DNA, 20 bp, Artificial Sequence
  Description of Artificial Sequence: Synthetic oligonucleotide
gggacagcccactggcttgc

SEQ ID NO: 11534 - DNA, 20 bp, Artificial Sequence
  Description of Artificial Sequence: Synthetic oligonucleotide
ggacagcccactggcttgca

SEQ ID NO: 11535 - DNA, 20 bp, Artificial Sequence
  Description of Artificial Sequence: Synthetic oligonucleotide
gacagcccactggcttgcag

SEQ ID NO: 11536 - DNA, 20 bp, Artificial Sequence
  Description of Artificial Sequence: Synthetic oligonucleotide
acagcccactggcttgcaga

SEQ ID NO: 11537 - DNA, 20 bp, Artificial Sequence
  Description of Artificial Sequence: Synthetic oligonucleotide
cagcccactggcttgcagag

SEQ ID NO: 11538 - DNA, 20 bp, Artificial Sequence
  Description of Artificial Sequence: Synthetic oligonucleotide
agcccactggcttgcagagg

SEQ ID NO: 11539 - DNA, 20 bp, Artificial Sequence
  Description of Artificial Sequence: Synthetic oligonucleotide
gcccactggcttgcagagga

SEQ ID NO: 11540 - DNA, 20 bp, Artificial Sequence
  Description of Artificial Sequence: Synthetic oligonucleotide
cccactggcttgcagaggag

SEQ ID NO: 11541 - DNA, 20 bp, Artificial Sequence
  Description of Artificial Sequence: Synthetic oligonucleotide
ccactggcttgcagaggaga

SEQ ID NO: 11542 - DNA, 20 bp, Artificial Sequence
  Description of Artificial Sequence: Synthetic oligonucleotide
cactggcttgcagaggagaa

SEQ ID NO: 11543 - DNA, 20 bp, Artificial Sequence
  Description of Artificial Sequence: Synthetic oligonucleotide
actggcttgcagaggagaag

SEQ ID NO: 11544 - DNA, 20 bp, Artificial Sequence
  Description of Artificial Sequence: Synthetic oligonucleotide
ctggcttgcagaggagaagg

SEQ ID NO: 11545 - DNA, 20 bp, Artificial Sequence
  Description of Artificial Sequence: Synthetic oligonucleotide
tggcttgcagaggagaaggg

SEQ ID NO: 11546 - DNA, 20 bp, Artificial Sequence
  Description of Artificial Sequence: Synthetic oligonucleotide
ggcttgcagaggagaagggt

SEQ ID NO: 11547 - DNA, 20 bp, Artificial Sequence
  Description of Artificial Sequence: Synthetic oligonucleotide
gcttgcagaggagaagggtt

SEQ ID NO: 11548 - DNA, 20 bp, Artificial Sequence
  Description of Artificial Sequence: Synthetic oligonucleotide
cttgcagaggagaagggttg

SEQ ID NO: 11549 - DNA, 20 bp, Artificial Sequence
  Description of Artificial Sequence: Synthetic oligonucleotide
ttgcagaggagaagggttgg

SEQ ID NO: 11550 - DNA, 20 bp, Artificial Sequence
  Description of Artificial Sequence: Synthetic oligonucleotide
tgcagaggagaagggttggg

SEQ ID NO: 11551 - DNA, 20 bp, Artificial Sequence
  Description of Artificial Sequence: Synthetic oligonucleotide
gcagaggagaagggttgggt

SEQ ID NO: 11552 - DNA, 20 bp, Artificial Sequence
  Description of Artificial Sequence: Synthetic oligonucleotide
cagaggagaagggttgggtg

SEQ ID NO: 11553 - DNA, 20 bp, Artificial Sequence
  Description of Artificial Sequence: Synthetic oligonucleotide
agaggagaagggttgggtgg

SEQ ID NO: 11554 - DNA, 20 bp, Artificial Sequence
  Description of Artificial Sequence: Synthetic oligonucleotide
gaggagaagggttgggtggc

SEQ ID NO: 11555 - DNA, 20 bp, Artificial Sequence
  Description of Artificial Sequence: Synthetic oligonucleotide
aggagaagggttgggtggcc

SEQ ID NO: 11556 - DNA, 20 bp, Artificial Sequence
  Description of Artificial Sequence: Synthetic oligonucleotide
ggagaagggttgggtggcct

SEQ ID NO: 11557 - DNA, 20 bp, Artificial Sequence
  Description of Artificial Sequence: Synthetic oligonucleotide
gagaagggttgggtggcctg

SEQ ID NO: 11558 - DNA, 20 bp, Artificial Sequence
  Description of Artificial Sequence: Synthetic oligonucleotide
agaagggttgggtggcctgg

SEQ ID NO: 11559 - DNA, 20 bp, Artificial Sequence
  Description of Artificial Sequence: Synthetic oligonucleotide
gaagggttgggtggcctggc

SEQ ID NO: 11560 - DNA, 20 bp, Artificial Sequence
  Description of Artificial Sequence: Synthetic oligonucleotide
aagggttgggtggcctggct

SEQ ID NO: 11561 - DNA, 20 bp, Artificial Sequence
  Description of Artificial Sequence: Synthetic oligonucleotide
agggttgggtggcctggctg

SEQ ID NO: 11562 - DNA, 20 bp, Artificial Sequence
  Description of Artificial Sequence: Synthetic oligonucleotide
gggttgggtggcctggctgg

SEQ ID NO: 11563 - DNA, 20 bp, Artificial Sequence
  Description of Artificial Sequence: Synthetic oligonucleotide
ggttgggtggcctggctggg

SEQ ID NO: 11564 - DNA, 20 bp, Artificial Sequence
  Description of Artificial Sequence: Synthetic oligonucleotide
gttgggtggcctggctgggc

SEQ ID NO: 11565 - DNA, 20 bp, Artificial Sequence
  Description of Artificial Sequence: Synthetic oligonucleotide
ttgggtggcctggctgggcc

SEQ ID NO: 11566 - DNA, 20 bp, Artificial Sequence
  Description of Artificial Sequence: Synthetic oligonucleotide
tgggtggcctggctgggcca

SEQ ID NO: 11567 - DNA, 20 bp, Artificial Sequence
  Description of Artificial Sequence: Synthetic oligonucleotide
gggtggcctggctgggccag

SEQ ID NO: 11568 - DNA, 20 bp, Artificial Sequence
  Description of Artificial Sequence: Synthetic oligonucleotide
ggtggcctggctgggccagg

SEQ ID NO: 11569 - DNA, 20 bp, Artificial Sequence
  Description of Artificial Sequence: Synthetic oligonucleotide
gtggcctggctgggccaggt

SEQ ID NO: 11570 - DNA, 20 bp, Artificial Sequence
  Description of Artificial Sequence: Synthetic oligonucleotide
tggcctggctgggccaggtc

SEQ ID NO: 11571 - DNA, 20 bp, Artificial Sequence
  Description of Artificial Sequence: Synthetic oligonucleotide
ggcctggctgggccaggtca

SEQ ID NO: 11572 - DNA, 20 bp, Artificial Sequence
  Description of Artificial Sequence: Synthetic oligonucleotide
gcctggctgggccaggtcag

SEQ ID NO: 11573 - DNA, 20 bp, Artificial Sequence
  Description of Artificial Sequence: Synthetic oligonucleotide
cctggctgggccaggtcagg

SEQ ID NO: 11574 - DNA, 20 bp, Artificial Sequence
  Description of Artificial Sequence: Synthetic oligonucleotide
ctggctgggccaggtcaggg

SEQ ID NO: 11575 - DNA, 20 bp, Artificial Sequence
  Description of Artificial Sequence: Synthetic oligonucleotide
tggctgggccaggtcagggc

SEQ ID NO: 11576 - DNA, 20 bp, Artificial Sequence
  Description of Artificial Sequence: Synthetic oligonucleotide
ggctgggccaggtcagggct

SEQ ID NO: 11577 - DNA, 20 bp, Artificial Sequence
  Description of Artificial Sequence: Synthetic oligonucleotide
gctgggccaggtcagggctg

SEQ ID NO: 11578 - DNA, 20 bp, Artificial Sequence
  Description of Artificial Sequence: Synthetic oligonucleotide
ctgggccaggtcagggctga

SEQ ID NO: 11579 - DNA, 20 bp, Artificial Sequence
  Description of Artificial Sequence: Synthetic oligonucleotide
tgggccaggtcagggctgag

SEQ ID NO: 11580 - DNA, 20 bp, Artificial Sequence
  Description of Artificial Sequence: Synthetic oligonucleotide
gggccaggtcagggctgagg

SEQ ID NO: 11581 - DNA, 20 bp, Artificial Sequence
  Description of Artificial Sequence: Synthetic oligonucleotide
ggccaggtcagggctgagga

SEQ ID NO: 11582 - DNA, 20 bp, Artificial Sequence
  Description of Artificial Sequence: Synthetic oligonucleotide
gccaggtcagggctgaggaa

SEQ ID NO: 11583 - DNA, 20 bp, Artificial Sequence
  Description of Artificial Sequence: Synthetic oligonucleotide
ccaggtcagggctgaggaag

SEQ ID NO: 11584 - DNA, 20 bp, Artificial Sequence
  Description of Artificial Sequence: Synthetic oligonucleotide
caggtcagggctgaggaagg

SEQ ID NO: 11585 - DNA, 20 bp, Artificial Sequence
  Description of Artificial Sequence: Synthetic oligonucleotide
aggtcagggctgaggaagga

SEQ ID NO: 11586 - DNA, 20 bp, Artificial Sequence
  Description of Artificial Sequence: Synthetic oligonucleotide
ggtcagggctgaggaaggag

SEQ ID NO: 11587 - DNA, 20 bp, Artificial Sequence
  Description of Artificial Sequence: Synthetic oligonucleotide
gtcagggctgaggaaggagg

SEQ ID NO: 11588 - DNA, 20 bp, Artificial Sequence
  Description of Artificial Sequence: Synthetic oligonucleotide
tcagggctgaggaaggaggt

SEQ ID NO: 11589 - DNA, 20 bp, Artificial Sequence
  Description of Artificial Sequence: Synthetic oligonucleotide
cagggctgaggaaggaggtg

SEQ ID NO: 11590 - DNA, 20 bp, Artificial Sequence
  Description of Artificial Sequence: Synthetic oligonucleotide
agggctgaggaaggaggtgc

SEQ ID NO: 11591 - DNA, 20 bp, Artificial Sequence
  Description of Artificial Sequence: Synthetic oligonucleotide
gggctgaggaaggaggtgct

SEQ ID NO: 11592 - DNA, 20 bp, Artificial Sequence
  Description of Artificial Sequence: Synthetic oligonucleotide
ggctgaggaaggaggtgctc

SEQ ID NO: 11593 - DNA, 20 bp, Artificial Sequence
  Description of Artificial Sequence: Synthetic oligonucleotide
gctgaggaaggaggtgctcc

SEQ ID NO: 11594 - DNA, 20 bp, Artificial Sequence
  Description of Artificial Sequence: Synthetic oligonucleotide
ctgaggaaggaggtgctccc

SEQ ID NO: 11595 - DNA, 20 bp, Artificial Sequence
  Description of Artificial Sequence: Synthetic oligonucleotide
tgaggaaggaggtgctccca

SEQ ID NO: 11596 - DNA, 20 bp, Artificial Sequence
  Description of Artificial Sequence: Synthetic oligonucleotide
gaggaaggaggtgctcccat

SEQ ID NO: 11597 - DNA, 20 bp, Artificial Sequence
  Description of Artificial Sequence: Synthetic oligonucleotide
aggaaggaggtgctcccatc

SEQ ID NO: 11598 - DNA, 20 bp, Artificial Sequence
  Description of Artificial Sequence: Synthetic oligonucleotide
ggaaggaggtgctcccatca

SEQ ID NO: 11599 - DNA, 20 bp, Artificial Sequence
  Description of Artificial Sequence: Synthetic oligonucleotide
gaaggaggtgctcccatcag

SEQ ID NO: 11600 - DNA, 20 bp, Artificial Sequence
  Description of Artificial Sequence: Synthetic oligonucleotide
aaggaggtgctcccatcagc

SEQ ID NO: 11601 - DNA, 20 bp, Artificial Sequence
  Description of Artificial Sequence: Synthetic oligonucleotide
aggaggtgctcccatcagct

SEQ ID NO: 11602 - DNA, 20 bp, Artificial Sequence
  Description of Artificial Sequence: Synthetic oligonucleotide
ggaggtgctcccatcagctt

SEQ ID NO: 11603 - DNA, 20 bp, Artificial Sequence
  Description of Artificial Sequence: Synthetic oligonucleotide
gaggtgctcccatcagcttt

SEQ ID NO: 11604 - DNA, 20 bp, Artificial Sequence
  Description of Artificial Sequence: Synthetic oligonucleotide
aggtgctcccatcagctttg

SEQ ID NO: 11605 - DNA, 20 bp, Artificial Sequence
  Description of Artificial Sequence: Synthetic oligonucleotide
ggtgctcccatcagctttga

SEQ ID NO: 11606 - DNA, 20 bp, Artificial Sequence
  Description of Artificial Sequence: Synthetic oligonucleotide
gtgctcccatcagctttgac

SEQ ID NO: 11607 - DNA, 20 bp, Artificial Sequence
  Description of Artificial Sequence: Synthetic oligonucleotide
tgctcccatcagctttgacc

SEQ ID NO: 11608 - DNA, 20 bp, Artificial Sequence
  Description of Artificial Sequence: Synthetic oligonucleotide
gctcccatcagctttgaccc

SEQ ID NO: 11609 - DNA, 20 bp, Artificial Sequence
  Description of Artificial Sequence: Synthetic oligonucleotide
ctcccatcagctttgaccca

SEQ ID NO: 11610 - DNA, 20 bp, Artificial Sequence
  Description of Artificial Sequence: Synthetic oligonucleotide
tcccatcagctttgacccag

SEQ ID NO: 11611 - DNA, 20 bp, Artificial Sequence
  Description of Artificial Sequence: Synthetic oligonucleotide
cccatcagctttgacccaga

SEQ ID NO: 11612 - DNA, 20 bp, Artificial Sequence
  Description of Artificial Sequence: Synthetic oligonucleotide
ccatcagctttgacccagag

SEQ ID NO: 11613 - DNA, 20 bp, Artificial Sequence
  Description of Artificial Sequence: Synthetic oligonucleotide
catcagctttgacccagaga

SEQ ID NO: 11614 - DNA, 20 bp, Artificial Sequence
  Description of Artificial Sequence: Synthetic oligonucleotide
atcagctttgacccagagac

SEQ ID NO: 11615 - DNA, 20 bp, Artificial Sequence
  Description of Artificial Sequence: Synthetic oligonucleotide
tcagctttgacccagagact

SEQ ID NO: 11616 - DNA, 20 bp, Artificial Sequence
  Description of Artificial Sequence: Synthetic oligonucleotide
cagctttgacccagagactg

SEQ ID NO: 11617 - DNA, 20 bp, Artificial Sequence
  Description of Artificial Sequence: Synthetic oligonucleotide
agctttgacccagagactgg

SEQ ID NO: 11618 - DNA, 20 bp, Artificial Sequence
  Description of Artificial Sequence: Synthetic oligonucleotide
gctttgacccagagactggt

SEQ ID NO: 11619 - DNA, 20 bp, Artificial Sequence
  Description of Artificial Sequence: Synthetic oligonucleotide
ctttgacccagagactggtg

SEQ ID NO: 11620 - DNA, 20 bp, Artificial Sequence
  Description of Artificial Sequence: Synthetic oligonucleotide
tttgacccagagactggtga

SEQ ID NO: 11621 - DNA, 20 bp, Artificial Sequence
  Description of Artificial Sequence: Synthetic oligonucleotide
ttgacccagagactggtgag

SEQ ID NO: 11622 - DNA, 20 bp, Artificial Sequence
  Description of Artificial Sequence: Synthetic oligonucleotide
tgacccagagactggtgagc

SEQ ID NO: 11623 - DNA, 20 bp, Artificial Sequence
  Description of Artificial Sequence: Synthetic oligonucleotide
gacccagagactggtgagcc

SEQ ID NO: 11624 - DNA, 20 bp, Artificial Sequence
  Description of Artificial Sequence: Synthetic oligonucleotide
acccagagactggtgagccc

SEQ ID NO: 11625 - DNA, 20 bp, Artificial Sequence
  Description of Artificial Sequence: Synthetic oligonucleotide
cccagagactggtgagccct

SEQ ID NO: 11626 - DNA, 20 bp, Artificial Sequence
  Description of Artificial Sequence: Synthetic oligonucleotide
ccagagactggtgagccctc

SEQ ID NO: 11627 - DNA, 20 bp, Artificial Sequence
  Description of Artificial Sequence: Synthetic oligonucleotide
cagagactggtgagccctca

SEQ ID NO: 11628 - DNA, 20 bp, Artificial Sequence
  Description of Artificial Sequence: Synthetic oligonucleotide
agagactggtgagccctcag

SEQ ID NO: 11629 - DNA, 20 bp, Artificial Sequence
  Description of Artificial Sequence: Synthetic oligonucleotide
gagactggtgagccctcagg

SEQ ID NO: 11630 - DNA, 20 bp, Artificial Sequence
  Description of Artificial Sequence: Synthetic oligonucleotide
agactggtgagccctcaggg

SEQ ID NO: 11631 - DNA, 20 bp, Artificial Sequence
  Description of Artificial Sequence: Synthetic oligonucleotide
gactggtgagccctcaggga

SEQ ID NO: 11632 - DNA, 20 bp, Artificial Sequence
  Description of Artificial Sequence: Synthetic oligonucleotide
actggtgagccctcagggac

SEQ ID NO: 11633 - DNA, 20 bp, Artificial Sequence
  Description of Artificial Sequence: Synthetic oligonucleotide
ctggtgagccctcagggact

SEQ ID NO: 11634 - DNA, 20 bp, Artificial Sequence
  Description of Artificial Sequence: Synthetic oligonucleotide
tggtgagccctcagggactc

SEQ ID NO: 11635 - DNA, 20 bp, Artificial Sequence
  Description of Artificial Sequence: Synthetic oligonucleotide
ggtgagccctcagggactcc

SEQ ID NO: 11636 - DNA, 20 bp, Artificial Sequence
  Description of Artificial Sequence: Synthetic oligonucleotide
gtgagccctcagggactcca

SEQ ID NO: 11637 - DNA, 20 bp, Artificial Sequence
  Description of Artificial Sequence: Synthetic oligonucleotide
tgagccctcagggactccag

SEQ ID NO: 11638 - DNA, 20 bp, Artificial Sequence
  Description of Artificial Sequence: Synthetic oligonucleotide
gagccctcagggactccagg

SEQ ID NO: 11639 - DNA, 20 bp, Artificial Sequence
  Description of Artificial Sequence: Synthetic oligonucleotide
agccctcagggactccaggc

SEQ ID NO: 11640 - DNA, 20 bp, Artificial Sequence
  Description of Artificial Sequence: Synthetic oligonucleotide
gccctcagggactccaggcc

SEQ ID NO: 11641 - DNA, 20 bp, Artificial Sequence
  Description of Artificial Sequence: Synthetic oligonucleotide
ccctcagggactccaggcca

SEQ ID NO: 11642 - DNA, 20 bp, Artificial Sequence
  Description of Artificial Sequence: Synthetic oligonucleotide
cctcagggactccaggccag

SEQ ID NO: 11643 - DNA, 20 bp, Artificial Sequence
  Description of Artificial Sequence: Synthetic oligonucleotide
ctcagggactccaggccagg

SEQ ID NO: 11644 - DNA, 20 bp, Artificial Sequence
  Description of Artificial Sequence: Synthetic oligonucleotide
tcagggactccaggccagga

SEQ ID NO: 11645 - DNA, 20 bp, Artificial Sequence
  Description of Artificial Sequence: Synthetic oligonucleotide
cagggactccaggccaggac

SEQ ID NO: 11646 - DNA, 20 bp, Artificial Sequence
  Description of Artificial Sequence: Synthetic oligonucleotide
agggactccaggccaggaca

SEQ ID NO: 11647 - DNA, 20 bp, Artificial Sequence
  Description of Artificial Sequence: Synthetic oligonucleotide
gggactccaggccaggacat

SEQ ID NO: 11648 - DNA, 20 bp, Artificial Sequence
  Description of Artificial Sequence: Synthetic oligonucleotide
ggactccaggccaggacatc

SEQ ID NO: 11649 - DNA, 20 bp, Artificial Sequence
  Description of Artificial Sequence: Synthetic oligonucleotide
gactccaggccaggacatct

SEQ ID NO: 11650 - DNA, 20 bp, Artificial Sequence
  Description of Artificial Sequence: Synthetic oligonucleotide
actccaggccaggacatctt

SEQ ID NO: 11651 - DNA, 20 bp, Artificial Sequence
  Description of Artificial Sequence: Synthetic oligonucleotide
ctccaggccaggacatcttc

SEQ ID NO: 11652 - DNA, 20 bp, Artificial Sequence
  Description of Artificial Sequence: Synthetic oligonucleotide
tccaggccaggacatcttct

SEQ ID NO: 11653 - DNA, 20 bp, Artificial Sequence
  Description of Artificial Sequence: Synthetic oligonucleotide
ccaggccaggacatcttctc

SEQ ID NO: 11654 - DNA, 20 bp, Artificial Sequence
  Description of Artificial Sequence: Synthetic oligonucleotide
caggccaggacatcttctcc

SEQ ID NO: 11655 - DNA, 20 bp, Artificial Sequence
  Description of Artificial Sequence: Synthetic oligonucleotide
aggccaggacatcttctcct

SEQ ID NO: 11656 - DNA, 20 bp, Artificial Sequence
  Description of Artificial Sequence: Synthetic oligonucleotide
ggccaggacatcttctcctt

SEQ ID NO: 11657 - DNA, 20 bp, Artificial Sequence
  Description of Artificial Sequence: Synthetic oligonucleotide
gccaggacatcttctcctta

SEQ ID NO: 11658 - DNA, 20 bp, Artificial Sequence
  Description of Artificial Sequence: Synthetic oligonucleotide
ccaggacatcttctccttaa

SEQ ID NO: 11659 - DNA, 20 bp, Artificial Sequence
  Description of Artificial Sequence: Synthetic oligonucleotide
caggacatcttctccttaag

SEQ ID NO: 11660 - DNA, 20 bp, Artificial Sequence
  Description of Artificial Sequence: Synthetic oligonucleotide
aggacatcttctccttaagg

SEQ ID NO: 11661 - DNA, 20 bp, Artificial Sequence
  Description of Artificial Sequence: Synthetic oligonucleotide
ggacatcttctccttaaggt

SEQ ID NO: 11662 - DNA, 20 bp, Artificial Sequence
  Description of Artificial Sequence: Synthetic oligonucleotide
gacatcttctccttaaggtg

SEQ ID NO: 11663 - DNA, 20 bp, Artificial Sequence
  Description of Artificial Sequence: Synthetic oligonucleotide
acatcttctccttaaggtgg

SEQ ID NO: 11664 - DNA, 20 bp, Artificial Sequence
  Description of Artificial Sequence: Synthetic oligonucleotide
catcttctccttaaggtgga

SEQ ID NO: 11665 - DNA, 20 bp, Artificial Sequence
  Description of Artificial Sequence: Synthetic oligonucleotide
atcttctccttaaggtggac

SEQ ID NO: 11666 - DNA, 20 bp, Artificial Sequence
  Description of Artificial Sequence: Synthetic oligonucleotide
tcttctccttaaggtggacc

SEQ ID NO: 11667 - DNA, 20 bp, Artificial Sequence
  Description of Artificial Sequence: Synthetic oligonucleotide
cttctccttaaggtggacct

SEQ ID NO: 11668 - DNA, 20 bp, Artificial Sequence
  Description of Artificial Sequence: Synthetic oligonucleotide
ttctccttaaggtggacctg

SEQ ID NO: 11669 - DNA, 20 bp, Artificial Sequence
  Description of Artificial Sequence: Synthetic oligonucleotide
tctccttaaggtggacctga

SEQ ID NO: 11670 - DNA, 20 bp, Artificial Sequence
  Description of Artificial Sequence: Synthetic oligonucleotide
ctccttaaggtggacctgac

SEQ ID NO: 11671 - DNA, 20 bp, Artificial Sequence
  Description of Artificial Sequence: Synthetic oligonucleotide
tccttaaggtggacctgaca

SEQ ID NO: 11672 - DNA, 20 bp, Artificial Sequence
  Description of Artificial Sequence: Synthetic oligonucleotide
ccttaaggtggacctgacaa

SEQ ID NO: 11673 - DNA, 20 bp, Artificial Sequence
  Description of Artificial Sequence: Synthetic oligonucleotide
cttaaggtggacctgacaag

SEQ ID NO: 11674 - DNA, 20 bp, Artificial Sequence
  Description of Artificial Sequence: Synthetic oligonucleotide
ttaaggtggacctgacaagg

SEQ ID NO: 11675 - DNA, 20 bp, Artificial Sequence
  Description of Artificial Sequence: Synthetic oligonucleotide
taaggtggacctgacaagga

SEQ ID NO: 11676 - DNA, 20 bp, Artificial Sequence
  Description of Artificial Sequence: Synthetic oligonucleotide
aaggtggacctgacaaggag

SEQ ID NO: 11677 - DNA, 20 bp, Artificial Sequence
  Description of Artificial Sequence: Synthetic oligonucleotide
aggtggacctgacaaggaga

SEQ ID NO: 11678 - DNA, 20 bp, Artificial Sequence
  Description of Artificial Sequence: Synthetic oligonucleotide
ggtggacctgacaaggagag

SEQ ID NO: 11679 - DNA, 20 bp, Artificial Sequence
  Description of Artificial Sequence: Synthetic oligonucleotide
gtggacctgacaaggagagg

SEQ ID NO: 11680 - DNA, 20 bp, Artificial Sequence
  Description of Artificial Sequence: Synthetic oligonucleotide
tggacctgacaaggagagga

SEQ ID NO: 11681 - DNA, 20 bp, Artificial Sequence
  Description of Artificial Sequence: Synthetic oligonucleotide
ggacctgacaaggagaggac

SEQ ID NO: 11682 - DNA, 20 bp, Artificial Sequence
  Description of Artificial Sequence: Synthetic oligonucleotide
gacctgacaaggagaggacc

SEQ ID NO: 11683 - DNA, 20 bp, Artificial Sequence
  Description of Artificial Sequence: Synthetic oligonucleotide
acctgacaaggagaggacca

SEQ ID NO: 11684 - DNA, 20 bp, Artificial Sequence
  Description of Artificial Sequence: Synthetic oligonucleotide
cctgacaaggagaggaccag

SEQ ID NO: 11685 - DNA, 20 bp, Artificial Sequence
  Description of Artificial Sequence: Synthetic oligonucleotide
ctgacaaggagaggaccagc

SEQ ID NO: 11686 - DNA, 20 bp, Artificial Sequence
  Description of Artificial Sequence: Synthetic oligonucleotide
tgacaaggagaggaccagca

SEQ ID NO: 11687 - DNA, 20 bp, Artificial Sequence
  Description of Artificial Sequence: Synthetic oligonucleotide
gacaaggagaggaccagcaa

SEQ ID NO: 11688 - DNA, 20 bp, Artificial Sequence
  Description of Artificial Sequence: Synthetic oligonucleotide
acaaggagaggaccagcaat

SEQ ID NO: 11689 - DNA, 20 bp, Artificial Sequence
  Description of Artificial Sequence: Synthetic oligonucleotide
caaggagaggaccagcaatg

SEQ ID NO: 11690 - DNA, 20 bp, Artificial Sequence
  Description of Artificial Sequence: Synthetic oligonucleotide
aaggagaggaccagcaatgg

SEQ ID NO: 11691 - DNA, 20 bp, Artificial Sequence
  Description of Artificial Sequence: Synthetic oligonucleotide
aggagaggaccagcaatggc

SEQ ID NO: 11692 - DNA, 20 bp, Artificial Sequence
  Description of Artificial Sequence: Synthetic oligonucleotide
ggagaggaccagcaatggca

SEQ ID NO: 11693 - DNA, 20 bp, Artificial Sequence
  Description of Artificial Sequence: Synthetic oligonucleotide
gagaggaccagcaatggcaa

SEQ ID NO: 11694 - DNA, 20 bp, Artificial Sequence
  Description of Artificial Sequence: Synthetic oligonucleotide
agaggaccagcaatggcaag

SEQ ID NO: 11695 - DNA, 20 bp, Artificial Sequence
  Description of Artificial Sequence: Synthetic oligonucleotide
gaggaccagcaatggcaagt

SEQ ID NO: 11696 - DNA, 20 bp, Artificial Sequence
  Description of Artificial Sequence: Synthetic oligonucleotide
aggaccagcaatggcaagtg

SEQ ID NO: 11697 - DNA, 20 bp, Artificial Sequence
  Description of Artificial Sequence: Synthetic oligonucleotide
ggaccagcaatggcaagtgg

SEQ ID NO: 11698 - DNA, 20 bp, Artificial Sequence
  Description of Artificial Sequence: Synthetic oligonucleotide
gaccagcaatggcaagtggc

SEQ ID NO: 11699 - DNA, 20 bp, Artificial Sequence
  Description of Artificial Sequence: Synthetic oligonucleotide
accagcaatggcaagtggcg

SEQ ID NO: 11700 - DNA, 20 bp, Artificial Sequence
  Description of Artificial Sequence: Synthetic oligonucleotide
ccagcaatggcaagtggcgg

SEQ ID NO: 11701 - DNA, 20 bp, Artificial Sequence
  Description of Artificial Sequence: Synthetic oligonucleotide
cagcaatggcaagtggcggg

SEQ ID NO: 11702 - DNA, 20 bp, Artificial Sequence
  Description of Artificial Sequence: Synthetic oligonucleotide
agcaatggcaagtggcgggg

SEQ ID NO: 11703 - DNA, 20 bp, Artificial Sequence
  Description of Artificial Sequence: Synthetic oligonucleotide
gcaatggcaagtggcggggt

SEQ ID NO: 11704 - DNA, 20 bp, Artificial Sequence
  Description of Artificial Sequence: Synthetic oligonucleotide
caatggcaagtggcggggta

SEQ ID NO: 11705 - DNA, 20 bp, Artificial Sequence
  Description of Artificial Sequence: Synthetic oligonucleotide
aatggcaagtggcggggtag

SEQ ID NO: 11706 - DNA, 20 bp, Artificial Sequence
  Description of Artificial Sequence: Synthetic oligonucleotide
atggcaagtggcggggtagg

SEQ ID NO: 11707 - DNA, 20 bp, Artificial Sequence
  Description of Artificial Sequence: Synthetic oligonucleotide
tggcaagtggcggggtaggg

SEQ ID NO: 11708 - DNA, 20 bp, Artificial Sequence
  Description of Artificial Sequence: Synthetic oligonucleotide
ggcaagtggcggggtagggg

SEQ ID NO: 11709 - DNA, 20 bp, Artificial Sequence
  Description of Artificial Sequence: Synthetic oligonucleotide
gcaagtggcggggtaggggt

SEQ ID NO: 11710 - DNA, 20 bp, Artificial Sequence
  Description of Artificial Sequence: Synthetic oligonucleotide
caagtggcggggtaggggtg

SEQ ID NO: 11711 - DNA, 20 bp, Artificial Sequence
  Description of Artificial Sequence: Synthetic oligonucleotide
aagtggcggggtaggggtgg

SEQ ID NO: 11712 - DNA, 20 bp, Artificial Sequence
  Description of Artificial Sequence: Synthetic oligonucleotide
agtggcggggtaggggtggc

SEQ ID NO: 11713 - DNA, 20 bp, Artificial Sequence
  Description of Artificial Sequence: Synthetic oligonucleotide
gtggcggggtaggggtggcc

SEQ ID NO: 11714 - DNA, 20 bp, Artificial Sequence
  Description of Artificial Sequence: Synthetic oligonucleotide
tggcggggtaggggtggcca

SEQ ID NO: 11715 - DNA, 20 bp, Artificial Sequence
  Description of Artificial Sequence: Synthetic oligonucleotide
ggcggggtaggggtggccac

SEQ ID NO: 11716 - DNA, 20 bp, Artificial Sequence
  Description of Artificial Sequence: Synthetic oligonucleotide
gcggggtaggggtggccacc

SEQ ID NO: 11717 - DNA, 20 bp, Artificial Sequence
  Description of Artificial Sequence: Synthetic oligonucleotide
cggggtaggggtggccaccg

SEQ ID NO: 11718 - DNA, 20 bp, Artificial Sequence
  Description of Artificial Sequence: Synthetic oligonucleotide
ggggtaggggtggccaccgg

SEQ ID NO: 11719 - DNA, 20 bp, Artificial Sequence
  Description of Artificial Sequence: Synthetic oligonucleotide
gggtaggggtggccaccgga

SEQ ID NO: 11720 - DNA, 20 bp, Artificial Sequence
  Description of Artificial Sequence: Synthetic oligonucleotide
ggtaggggtggccaccggag

SEQ ID NO: 11721 - DNA, 20 bp, Artificial Sequence
  Description of Artificial Sequence: Synthetic oligonucleotide
gtaggggtggccaccggaga

SEQ ID NO: 11722 - DNA, 20 bp, Artificial Sequence
  Description of Artificial Sequence: Synthetic oligonucleotide
taggggtggccaccggagag

SEQ ID NO: 11723 - DNA, 20 bp, Artificial Sequence
  Description of Artificial Sequence: Synthetic oligonucleotide
aggggtggccaccggagagc

SEQ ID NO: 11724 - DNA, 20 bp, Artificial Sequence
  Description of Artificial Sequence: Synthetic oligonucleotide
ggggtggccaccggagagca

SEQ ID NO: 11725 - DNA, 20 bp, Artificial Sequence
  Description of Artificial Sequence: Synthetic oligonucleotide
gggtggccaccggagagcat

SEQ ID NO: 11726 - DNA, 20 bp, Artificial Sequence
  Description of Artificial Sequence: Synthetic oligonucleotide
ggtggccaccggagagcatc

SEQ ID NO: 11727 - DNA, 20 bp, Artificial Sequence
  Description of Artificial Sequence: Synthetic oligonucleotide
gtggccaccggagagcatcg

SEQ ID NO: 11728 - DNA, 20 bp, Artificial Sequence
  Description of Artificial Sequence: Synthetic oligonucleotide
tggccaccggagagcatcga

SEQ ID NO: 11729 - DNA, 20 bp, Artificial Sequence
  Description of Artificial Sequence: Synthetic oligonucleotide
ggccaccggagagcatcgag

SEQ ID NO: 11730 - DNA, 20 bp, Artificial Sequence
  Description of Artificial Sequence: Synthetic oligonucleotide
gccaccggagagcatcgagg

SEQ ID NO: 11731 - DNA, 20 bp, Artificial Sequence
  Description of Artificial Sequence: Synthetic oligonucleotide
ccaccggagagcatcgaggg

SEQ ID NO: 11732 - DNA, 20 bp, Artificial Sequence
  Description of Artificial Sequence: Synthetic oligonucleotide
caccggagagcatcgagggg

SEQ ID NO: 11733 - DNA, 20 bp, Artificial Sequence
  Description of Artificial Sequence: Synthetic oligonucleotide
accggagagcatcgaggggc

SEQ ID NO: 11734 - DNA, 20 bp, Artificial Sequence
  Description of Artificial Sequence: Synthetic oligonucleotide
ccggagagcatcgaggggca

SEQ ID NO: 11735 - DNA, 20 bp, Artificial Sequence
  Description of Artificial Sequence: Synthetic oligonucleotide
cggagagcatcgaggggcag

SEQ ID NO: 11736 - DNA, 20 bp, Artificial Sequence
  Description of Artificial Sequence: Synthetic oligonucleotide
ggagagcatcgaggggcaga

SEQ ID NO: 11737 - DNA, 20 bp, Artificial Sequence
  Description of Artificial Sequence: Synthetic oligonucleotide
gagagcatcgaggggcagac

SEQ ID NO: 11738 - DNA, 20 bp, Artificial Sequence
  Description of Artificial Sequence: Synthetic oligonucleotide
agagcatcgaggggcagaca

SEQ ID NO: 11739 - DNA, 20 bp, Artificial Sequence
  Description of Artificial Sequence: Synthetic oligonucleotide
gagcatcgaggggcagacac

SEQ ID NO: 11740 - DNA, 20 bp, Artificial Sequence
  Description of Artificial Sequence: Synthetic oligonucleotide
agcatcgaggggcagacact

SEQ ID NO: 11741 - DNA, 20 bp, Artificial Sequence
  Description of Artificial Sequence: Synthetic oligonucleotide
gcatcgaggggcagacactc

SEQ ID NO: 11742 - DNA, 20 bp, Artificial Sequence
  Description of Artificial Sequence: Synthetic oligonucleotide
catcgaggggcagacactca

SEQ ID NO: 11743 - DNA, 20 bp, Artificial Sequence
  Description of Artificial Sequence: Synthetic oligonucleotide
atcgaggggcagacactcac

SEQ ID NO: 11744 - DNA, 20 bp, Artificial Sequence
  Description of Artificial Sequence: Synthetic oligonucleotide
tcgaggggcagacactcacg

SEQ ID NO: 11745 - DNA, 20 bp, Artificial Sequence
  Description of Artificial Sequence: Synthetic oligonucleotide
cgaggggcagacactcacgg

SEQ ID NO: 11746 - DNA, 20 bp, Artificial Sequence
  Description of Artificial Sequence: Synthetic oligonucleotide
gaggggcagacactcacggt

SEQ ID NO: 11747 - DNA, 20 bp, Artificial Sequence
  Description of Artificial Sequence: Synthetic oligonucleotide
aggggcagacactcacggtg

SEQ ID NO: 11748 - DNA, 20 bp, Artificial Sequence
  Description of Artificial Sequence: Synthetic oligonucleotide
ggggcagacactcacggtgc

SEQ ID NO: 11749 - DNA, 20 bp, Artificial Sequence
  Description of Artificial Sequence: Synthetic oligonucleotide
gggcagacactcacggtgca

SEQ ID NO: 11750 - DNA, 20 bp, Artificial Sequence
  Description of Artificial Sequence: Synthetic oligonucleotide
ggcagacactcacggtgcag

SEQ ID NO: 11751 - DNA, 20 bp, Artificial Sequence
  Description of Artificial Sequence: Synthetic oligonucleotide
gcagacactcacggtgcagg

SEQ ID NO: 11752 - DNA, 20 bp, Artificial Sequence
  Description of Artificial Sequence: Synthetic oligonucleotide
cagacactcacggtgcaggc

SEQ ID NO: 11753 - DNA, 20 bp, Artificial Sequence
  Description of Artificial Sequence: Synthetic oligonucleotide
agacactcacggtgcaggcg

SEQ ID NO: 11754 - DNA, 20 bp, Artificial Sequence
  Description of Artificial Sequence: Synthetic oligonucleotide
gacactcacggtgcaggcgg

SEQ ID NO: 11755 - DNA, 20 bp, Artificial Sequence
  Description of Artificial Sequence: Synthetic oligonucleotide
acactcacggtgcaggcggc

SEQ ID NO: 11756 - DNA, 20 bp, Artificial Sequence
  Description of Artificial Sequence: Synthetic oligonucleotide
cactcacggtgcaggcggct

SEQ ID NO: 11757 - DNA, 20 bp, Artificial Sequence
  Description of Artificial Sequence: Synthetic oligonucleotide
actcacggtgcaggcggctg

SEQ ID NO: 11758 - DNA, 20 bp, Artificial Sequence
  Description of Artificial Sequence: Synthetic oligonucleotide
ctcacggtgcaggcggctga

SEQ ID NO: 11759 - DNA, 20 bp, Artificial Sequence
  Description of Artificial Sequence: Synthetic oligonucleotide
tcacggtgcaggcggctgac

SEQ ID NO: 11760 - DNA, 20 bp, Artificial Sequence
  Description of Artificial Sequence: Synthetic oligonucleotide
cacggtgcaggcggctgaca

SEQ ID NO: 11761 - DNA, 20 bp, Artificial Sequence
  Description of Artificial Sequence: Synthetic oligonucleotide
acggtgcaggcggctgacat

SEQ ID NO: 11762 - DNA, 20 bp, Artificial Sequence
  Description of Artificial Sequence: Synthetic oligonucleotide
cggtgcaggcggctgacatt

SEQ ID NO: 11763 - DNA, 20 bp, Artificial Sequence
  Description of Artificial Sequence: Synthetic oligonucleotide
ggtgcaggcggctgacattg

SEQ ID NO: 11764 - DNA, 20 bp, Artificial Sequence
  Description of Artificial Sequence: Synthetic oligonucleotide
gtgcaggcggctgacattgt

SEQ ID NO: 11765 - DNA, 20 bp, Artificial Sequence
  Description of Artificial Sequence: Synthetic oligonucleotide
tgcaggcggctgacattgtg

SEQ ID NO: 11766 - DNA, 20 bp, Artificial Sequence
  Description of Artificial Sequence: Synthetic oligonucleotide
gcaggcggctgacattgtga

SEQ ID NO: 11767 - DNA, 20 bp, Artificial Sequence
  Description of Artificial Sequence: Synthetic oligonucleotide
caggcggctgacattgtgag

SEQ ID NO: 11768 - DNA, 20 bp, Artificial Sequence
  Description of Artificial Sequence: Synthetic oligonucleotide
aggcggctgacattgtgagc

SEQ ID NO: 11769 - DNA, 20 bp, Artificial Sequence
  Description of Artificial Sequence: Synthetic oligonucleotide
ggcggctgacattgtgagcc

SEQ ID NO: 11770 - DNA, 20 bp, Artificial Sequence
  Description of Artificial Sequence: Synthetic oligonucleotide
gcggctgacattgtgagccg

SEQ ID NO: 11771 - DNA, 20 bp, Artificial Sequence
  Description of Artificial Sequence: Synthetic oligonucleotide
cggctgacattgtgagccgg

SEQ ID NO: 11772 - DNA, 20 bp, Artificial Sequence
  Description of Artificial Sequence: Synthetic oligonucleotide
ggctgacattgtgagccggg

SEQ ID NO: 11773 - DNA, 20 bp, Artificial Sequence
  Description of Artificial Sequence: Synthetic oligonucleotide
gctgacattgtgagccgggt

SEQ ID NO: 11774 - DNA, 20 bp, Artificial Sequence
  Description of Artificial Sequence: Synthetic oligonucleotide
ctgacattgtgagccgggtc

SEQ ID NO: 11775 - DNA, 20 bp, Artificial Sequence
  Description of Artificial Sequence: Synthetic oligonucleotide
tgacattgtgagccgggtca

SEQ ID NO: 11776 - DNA, 20 bp, Artificial Sequence
  Description of Artificial Sequence: Synthetic oligonucleotide
gacattgtgagccgggtcaa

SEQ ID NO: 11777 - DNA, 20 bp, Artificial Sequence
  Description of Artificial Sequence: Synthetic oligonucleotide
acattgtgagccgggtcaac

SEQ ID NO: 11778 - DNA, 20 bp, Artificial Sequence
  Description of Artificial Sequence: Synthetic oligonucleotide
cattgtgagccgggtcaact

SEQ ID NO: 11779 - DNA, 20 bp, Artificial Sequence
  Description of Artificial Sequence: Synthetic oligonucleotide
attgtgagccgggtcaactg

SEQ ID NO: 11780 - DNA, 20 bp, Artificial Sequence
  Description of Artificial Sequence: Synthetic oligonucleotide
ttgtgagccgggtcaactgg

SEQ ID NO: 11781 - DNA, 20 bp, Artificial Sequence
  Description of Artificial Sequence: Synthetic oligonucleotide
tgtgagccgggtcaactggc

SEQ ID NO: 11782 - DNA, 20 bp, Artificial Sequence
  Description of Artificial Sequence: Synthetic oligonucleotide
gtgagccgggtcaactggct

SEQ ID NO: 11783 - DNA, 20 bp, Artificial Sequence
  Description of Artificial Sequence: Synthetic oligonucleotide
tgagccgggtcaactggctg

SEQ ID NO: 11784 - DNA, 20 bp, Artificial Sequence
  Description of Artificial Sequence: Synthetic oligonucleotide
gagccgggtcaactggctgg

SEQ ID NO: 11785 - DNA, 20 bp, Artificial Sequence
  Description of Artificial Sequence: Synthetic oligonucleotide
agccgggtcaactggctggg

SEQ ID NO: 11786 - DNA, 20 bp, Artificial Sequence
  Description of Artificial Sequence: Synthetic oligonucleotide
gccgggtcaactggctgggc

SEQ ID NO: 11787 - DNA, 20 bp, Artificial Sequence
  Description of Artificial Sequence: Synthetic oligonucleotide
ccgggtcaactggctgggcc

SEQ ID NO: 11788 - DNA, 20 bp, Artificial Sequence
  Description of Artificial Sequence: Synthetic oligonucleotide
cgggtcaactggctgggcca

SEQ ID NO: 11789 - DNA, 20 bp, Artificial Sequence
  Description of Artificial Sequence: Synthetic oligonucleotide
gggtcaactggctgggccat

SEQ ID NO: 11790 - DNA, 20 bp, Artificial Sequence
  Description of Artificial Sequence: Synthetic oligonucleotide
ggtcaactggctgggccatc

SEQ ID NO: 11791 - DNA, 20 bp, Artificial Sequence
  Description of Artificial Sequence: Synthetic oligonucleotide
gtcaactggctgggccatct

SEQ ID NO: 11792 - DNA, 20 bp, Artificial Sequence
  Description of Artificial Sequence: Synthetic oligonucleotide
tcaactggctgggccatctc

SEQ ID NO: 11793 - DNA, 20 bp, Artificial Sequence
  Description of Artificial Sequence: Synthetic oligonucleotide
caactggctgggccatctcg

SEQ ID NO: 11794 - DNA, 20 bp, Artificial Sequence
  Description of Artificial Sequence: Synthetic oligonucleotide
aactggctgggccatctcgg

SEQ ID NO: 11795 - DNA, 20 bp, Artificial Sequence
  Description of Artificial Sequence: Synthetic oligonucleotide
actggctgggccatctcggg

SEQ ID NO: 11796 - DNA, 20 bp, Artificial Sequence
  Description of Artificial Sequence: Synthetic oligonucleotide
ctggctgggccatctcgggc

SEQ ID NO: 11797 - DNA, 20 bp, Artificial Sequence
  Description of Artificial Sequence: Synthetic oligonucleotide
tggctgggccatctcgggca

SEQ ID NO: 11798 - DNA, 20 bp, Artificial Sequence
  Description of Artificial Sequence: Synthetic oligonucleotide
ggctgggccatctcgggcag

SEQ ID NO: 11799 - DNA, 20 bp, Artificial Sequence
  Description of Artificial Sequence: Synthetic oligonucleotide
gctgggccatctcgggcagc

SEQ ID NO: 11800 - DNA, 20 bp, Artificial Sequence
  Description of Artificial Sequence: Synthetic oligonucleotide
ctgggccatctcgggcagcc

SEQ ID NO: 11801 - DNA, 20 bp, Artificial Sequence
  Description of Artificial Sequence: Synthetic oligonucleotide
tgggccatctcgggcagcct

SEQ ID NO: 11802 - DNA, 20 bp, Artificial Sequence
  Description of Artificial Sequence: Synthetic oligonucleotide
gggccatctcgggcagcctc

SEQ ID NO: 11803 - DNA, 20 bp, Artificial Sequence
  Description of Artificial Sequence: Synthetic oligonucleotide
ggccatctcgggcagcctct

SEQ ID NO: 11804 - DNA, 20 bp, Artificial Sequence
  Description of Artificial Sequence: Synthetic oligonucleotide
gccatctcgggcagcctctt

SEQ ID NO: 11805 - DNA, 20 bp, Artificial Sequence
  Description of Artificial Sequence: Synthetic oligonucleotide
ccatctcgggcagcctcttt

SEQ ID NO: 11806 - DNA, 20 bp, Artificial Sequence
  Description of Artificial Sequence: Synthetic oligonucleotide
catctcgggcagcctctttc

SEQ ID NO: 11807 - DNA, 20 bp, Artificial Sequence
  Description of Artificial Sequence: Synthetic oligonucleotide
atctcgggcagcctctttct

SEQ ID NO: 11808 - DNA, 20 bp, Artificial Sequence
  Description of Artificial Sequence: Synthetic oligonucleotide
tctcgggcagcctctttctt

SEQ ID NO: 11809 - DNA, 20 bp, Artificial Sequence
  Description of Artificial Sequence: Synthetic oligonucleotide
ctcgggcagcctctttcttc

SEQ ID NO: 11810 - DNA, 20 bp, Artificial Sequence
  Description of Artificial Sequence: Synthetic oligonucleotide
tcgggcagcctctttcttcg

SEQ ID NO: 11811 - DNA, 20 bp, Artificial Sequence
  Description of Artificial Sequence: Synthetic oligonucleotide
cgggcagcctctttcttcgg

SEQ ID NO: 11812 - DNA, 20 bp, Artificial Sequence
  Description of Artificial Sequence: Synthetic oligonucleotide
gggcagcctctttcttcggg

SEQ ID NO: 11813 - DNA, 20 bp, Artificial Sequence
  Description of Artificial Sequence: Synthetic oligonucleotide
ggcagcctctttcttcgggc

SEQ ID NO: 11814 - DNA, 20 bp, Artificial Sequence
  Description of Artificial Sequence: Synthetic oligonucleotide
gcagcctctttcttcgggca

SEQ ID NO: 11815 - DNA, 20 bp, Artificial Sequence
  Description of Artificial Sequence: Synthetic oligonucleotide
cagcctctttcttcgggcag

SEQ ID NO: 11816 - DNA, 20 bp, Artificial Sequence
  Description of Artificial Sequence: Synthetic oligonucleotide
agcctctttcttcgggcagg

SEQ ID NO: 11817 - DNA, 20 bp, Artificial Sequence
  Description of Artificial Sequence: Synthetic oligonucleotide
gcctctttcttcgggcaggc

SEQ ID NO: 11818 - DNA, 20 bp, Artificial Sequence
  Description of Artificial Sequence: Synthetic oligonucleotide
cctctttcttcgggcaggct

SEQ ID NO: 11819 - DNA, 20 bp, Artificial Sequence
  Description of Artificial Sequence: Synthetic oligonucleotide
ctctttcttcgggcaggctt

SEQ ID NO: 11820 - DNA, 20 bp, Artificial Sequence
  Description of Artificial Sequence: Synthetic oligonucleotide
tctttcttcgggcaggcttg

SEQ ID NO: 11821 - DNA, 20 bp, Artificial Sequence
  Description of Artificial Sequence: Synthetic oligonucleotide
ctttcttcgggcaggcttgg

SEQ ID NO: 11822 - DNA, 20 bp, Artificial Sequence
  Description of Artificial Sequence: Synthetic oligonucleotide
tttcttcgggcaggcttggc

SEQ ID NO: 11823 - DNA, 20 bp, Artificial Sequence
  Description of Artificial Sequence: Synthetic oligonucleotide
ttcttcgggcaggcttggcc

SEQ ID NO: 11824 - DNA, 20 bp, Artificial Sequence
  Description of Artificial Sequence: Synthetic oligonucleotide
tcttcgggcaggcttggcca

SEQ ID NO: 11825 - DNA, 20 bp, Artificial Sequence
  Description of Artificial Sequence: Synthetic oligonucleotide
cttcgggcaggcttggccac

SEQ ID NO: 11826 - DNA, 20 bp, Artificial Sequence
  Description of Artificial Sequence: Synthetic oligonucleotide
ttcgggcaggcttggccacc

SEQ ID NO: 11827 - DNA, 20 bp, Artificial Sequence
  Description of Artificial Sequence: Synthetic oligonucleotide
tcgggcaggcttggccacct

SEQ ID NO: 11828 - DNA, 20 bp, Artificial Sequence
  Description of Artificial Sequence: Synthetic oligonucleotide
cgggcaggcttggccacctc

SEQ ID NO: 11829 - DNA, 20 bp, Artificial Sequence
  Description of Artificial Sequence: Synthetic oligonucleotide
gggcaggcttggccacctca

SEQ ID NO: 11830 - DNA, 20 bp, Artificial Sequence
  Description of Artificial Sequence: Synthetic oligonucleotide
ggcaggcttggccacctcat

SEQ ID NO: 11831 - DNA, 20 bp, Artificial Sequence
  Description of Artificial Sequence: Synthetic oligonucleotide
gcaggcttggccacctcatg

SEQ ID NO: 11832 - DNA, 20 bp, Artificial Sequence
  Description of Artificial Sequence: Synthetic oligonucleotide
caggcttggccacctcatgg

SEQ ID NO: 11833 - DNA, 20 bp, Artificial Sequence
  Description of Artificial Sequence: Synthetic oligonucleotide
aggcttggccacctcatggt

SEQ ID NO: 11834 - DNA, 20 bp, Artificial Sequence
  Description of Artificial Sequence: Synthetic oligonucleotide
ggcttggccacctcatggtc

SEQ ID NO: 11835 - DNA, 20 bp, Artificial Sequence
  Description of Artificial Sequence: Synthetic oligonucleotide
gcttggccacctcatggtct

SEQ ID NO: 11836 - DNA, 20 bp, Artificial Sequence
  Description of Artificial Sequence: Synthetic oligonucleotide
cttggccacctcatggtcta

SEQ ID NO: 11837 - DNA, 20 bp, Artificial Sequence
  Description of Artificial Sequence: Synthetic oligonucleotide
ttggccacctcatggtctag

SEQ ID NO: 11838 - DNA, 20 bp, Artificial Sequence
  Description of Artificial Sequence: Synthetic oligonucleotide
tggccacctcatggtctagg

SEQ ID NO: 11839 - DNA, 20 bp, Artificial Sequence
  Description of Artificial Sequence: Synthetic oligonucleotide
ggccacctcatggtctaggt

SEQ ID NO: 11840 - DNA, 20 bp, Artificial Sequence
  Description of Artificial Sequence: Synthetic oligonucleotide
gccacctcatggtctaggtg

SEQ ID NO: 11841 - DNA, 20 bp, Artificial Sequence
  Description of Artificial Sequence: Synthetic oligonucleotide
ccacctcatggtctaggtgc

SEQ ID NO: 11842 - DNA, 20 bp, Artificial Sequence
  Description of Artificial Sequence: Synthetic oligonucleotide
cacctcatggtctaggtgct

SEQ ID NO: 11843 - DNA, 20 bp, Artificial Sequence
  Description of Artificial Sequence: Synthetic oligonucleotide
acctcatggtctaggtgctt

SEQ ID NO: 11844 - DNA, 20 bp, Artificial Sequence
  Description of Artificial Sequence: Synthetic oligonucleotide
cctcatggtctaggtgcttg

SEQ ID NO: 11845 - DNA, 20 bp, Artificial Sequence
  Description of Artificial Sequence: Synthetic oligonucleotide
ctcatggtctaggtgcttgt

SEQ ID NO: 11846 - DNA, 20 bp, Artificial Sequence
  Description of Artificial Sequence: Synthetic oligonucleotide
tcatggtctaggtgcttgtg

SEQ ID NO: 11847 - DNA, 20 bp, Artificial Sequence
  Description of Artificial Sequence: Synthetic oligonucleotide
catggtctaggtgcttgtgg

SEQ ID NO: 11848 - DNA, 20 bp, Artificial Sequence
  Description of Artificial Sequence: Synthetic oligonucleotide
atggtctaggtgcttgtggt

SEQ ID NO: 11849 - DNA, 20 bp, Artificial Sequence
  Description of Artificial Sequence: Synthetic oligonucleotide
tggtctaggtgcttgtggtc

SEQ ID NO: 11850 - DNA, 20 bp, Artificial Sequence
  Description of Artificial Sequence: Synthetic oligonucleotide
ggtctaggtgcttgtggtcc

SEQ ID NO: 11851 - DNA, 20 bp, Artificial Sequence
  Description of Artificial Sequence: Synthetic oligonucleotide
gtctaggtgcttgtggtcca

SEQ ID NO: 11852 - DNA, 20 bp, Artificial Sequence
  Description of Artificial Sequence: Synthetic oligonucleotide
tctaggtgcttgtggtccag

SEQ ID NO: 11853 - DNA, 20 bp, Artificial Sequence
  Description of Artificial Sequence: Synthetic oligonucleotide
ctaggtgcttgtggtccagg

SEQ ID NO: 11854 - DNA, 20 bp, Artificial Sequence
  Description of Artificial Sequence: Synthetic oligonucleotide
taggtgcttgtggtccagga

SEQ ID NO: 11855 - DNA, 20 bp, Artificial Sequence
  Description of Artificial Sequence: Synthetic oligonucleotide
aggtgcttgtggtccaggag

SEQ ID NO: 11856 - DNA, 20 bp, Artificial Sequence
  Description of Artificial Sequence: Synthetic oligonucleotide
ggtgcttgtggtccaggagg

SEQ ID NO: 11857 - DNA, 20 bp, Artificial Sequence
  Description of Artificial Sequence: Synthetic oligonucleotide
gtgcttgtggtccaggaggc

SEQ ID NO: 11858 - DNA, 20 bp, Artificial Sequence
  Description of Artificial Sequence: Synthetic oligonucleotide
tgcttgtggtccaggaggcc

SEQ ID NO: 11859 - DNA, 20 bp, Artificial Sequence
  Description of Artificial Sequence: Synthetic oligonucleotide
gcttgtggtccaggaggcca

SEQ ID NO: 11860 - DNA, 20 bp, Artificial Sequence
  Description of Artificial Sequence: Synthetic oligonucleotide
cttgtggtccaggaggccaa

SEQ ID NO: 11861 - DNA, 20 bp, Artificial Sequence
  Description of Artificial Sequence: Synthetic oligonucleotide
ttgtggtccaggaggccaaa

SEQ ID NO: 11862 - DNA, 20 bp, Artificial Sequence
  Description of Artificial Sequence: Synthetic oligonucleotide
tgtggtccaggaggccaaac

SEQ ID NO: 11863 - DNA, 20 bp, Artificial Sequence
  Description of Artificial Sequence: Synthetic oligonucleotide
gtggtccaggaggccaaact

SEQ ID NO: 11864 - DNA, 20 bp, Artificial Sequence
  Description of Artificial Sequence: Synthetic oligonucleotide
tggtccaggaggccaaacta

SEQ ID NO: 11865 - DNA, 20 bp, Artificial Sequence
  Description of Artificial Sequence: Synthetic oligonucleotide
ggtccaggaggccaaactag

SEQ ID NO: 11866 - DNA, 20 bp, Artificial Sequence
  Description of Artificial Sequence: Synthetic oligonucleotide
gtccaggaggccaaactagg

SEQ ID NO: 11867 - DNA, 20 bp, Artificial Sequence
  Description of Artificial Sequence: Synthetic oligonucleotide
tccaggaggccaaactagga

SEQ ID NO: 11868 - DNA, 20 bp, Artificial Sequence
  Description of Artificial Sequence: Synthetic oligonucleotide
ccaggaggccaaactaggat

SEQ ID NO: 11869 - DNA, 20 bp, Artificial Sequence
  Description of Artificial Sequence: Synthetic oligonucleotide
caggaggccaaactaggatg

SEQ ID NO: 11870 - DNA, 20 bp, Artificial Sequence
  Description of Artificial Sequence: Synthetic oligonucleotide
aggaggccaaactaggatgg

SEQ ID NO: 11871 - DNA, 20 bp, Artificial Sequence
  Description of Artificial Sequence: Synthetic oligonucleotide
ggaggccaaactaggatggg

SEQ ID NO: 11872 - DNA, 20 bp, Artificial Sequence
  Description of Artificial Sequence: Synthetic oligonucleotide
gaggccaaactaggatggga

SEQ ID NO: 11873 - DNA, 20 bp, Artificial Sequence
  Description of Artificial Sequence: Synthetic oligonucleotide
aggccaaactaggatgggac

SEQ ID NO: 11874 - DNA, 20 bp, Artificial Sequence
  Description of Artificial Sequence: Synthetic oligonucleotide
ggccaaactaggatgggacg

SEQ ID NO: 11875 - DNA, 20 bp, Artificial Sequence
  Description of Artificial Sequence: Synthetic oligonucleotide
gccaaactaggatgggacgg

SEQ ID NO: 11876 - DNA, 20 bp, Artificial Sequence
  Description of Artificial Sequence: Synthetic oligonucleotide
ccaaactaggatgggacggg

SEQ ID NO: 11877 - DNA, 20 bp, Artificial Sequence
  Description of Artificial Sequence: Synthetic oligonucleotide
caaactaggatgggacggga

SEQ ID NO: 11878 - DNA, 20 bp, Artificial Sequence
  Description of Artificial Sequence: Synthetic oligonucleotide
aaactaggatgggacgggag

SEQ ID NO: 11879 - DNA, 20 bp, Artificial Sequence
  Description of Artificial Sequence: Synthetic oligonucleotide
aactaggatgggacgggagg

SEQ ID NO: 11880 - DNA, 20 bp, Artificial Sequence
  Description of Artificial Sequence: Synthetic oligonucleotide
actaggatgggacgggagga

SEQ ID NO: 11881 - DNA, 20 bp, Artificial Sequence
  Description of Artificial Sequence: Synthetic oligonucleotide
ctaggatgggacgggaggag

SEQ ID NO: 11882 - DNA, 20 bp, Artificial Sequence
  Description of Artificial Sequence: Synthetic oligonucleotide
taggatgggacgggaggagg

SEQ ID NO: 11883 - DNA, 20 bp, Artificial Sequence
  Description of Artificial Sequence: Synthetic oligonucleotide
aggatgggacgggaggaggg

SEQ ID NO: 11884 - DNA, 20 bp, Artificial Sequence
  Description of Artificial Sequence: Synthetic oligonucleotide
ggatgggacgggaggagggt

SEQ ID NO: 11885 - DNA, 20 bp, Artificial Sequence
  Description of Artificial Sequence: Synthetic oligonucleotide
gatgggacgggaggagggtg

SEQ ID NO: 11886 - DNA, 20 bp, Artificial Sequence
  Description of Artificial Sequence: Synthetic oligonucleotide
atgggacgggaggagggtgt

SEQ ID NO: 11887 - DNA, 20 bp, Artificial Sequence
  Description of Artificial Sequence: Synthetic oligonucleotide
tgggacgggaggagggtgtc

SEQ ID NO: 11888 - DNA, 20 bp, Artificial Sequence
  Description of Artificial Sequence: Synthetic oligonucleotide
gggacgggaggagggtgtca

SEQ ID NO: 11889 - DNA, 20 bp, Artificial Sequence
  Description of Artificial Sequence: Synthetic oligonucleotide
ggacgggaggagggtgtcag

SEQ ID NO: 11890 - DNA, 20 bp, Artificial Sequence
  Description of Artificial Sequence: Synthetic oligonucleotide
gacgggaggagggtgtcagg

SEQ ID NO: 11891 - DNA, 20 bp, Artificial Sequence
  Description of Artificial Sequence: Synthetic oligonucleotide
acgggaggagggtgtcaggt

SEQ ID NO: 11892 - DNA, 20 bp, Artificial Sequence
  Description of Artificial Sequence: Synthetic oligonucleotide
cgggaggagggtgtcaggtc

SEQ ID NO: 11893 - DNA, 20 bp, Artificial Sequence
  Description of Artificial Sequence: Synthetic oligonucleotide
gggaggagggtgtcaggtcc

SEQ ID NO: 11894 - DNA, 20 bp, Artificial Sequence
  Description of Artificial Sequence: Synthetic oligonucleotide
ggaggagggtgtcaggtcct

SEQ ID NO: 11895 - DNA, 20 bp, Artificial Sequence
  Description of Artificial Sequence: Synthetic oligonucleotide
gaggagggtgtcaggtcctg

SEQ ID NO: 11896 - DNA, 20 bp, Artificial Sequence
  Description of Artificial Sequence: Synthetic oligonucleotide
aggagggtgtcaggtcctgc

SEQ ID NO: 11897 - DNA, 20 bp, Artificial Sequence
  Description of Artificial Sequence: Synthetic oligonucleotide
ggagggtgtcaggtcctgcc

SEQ ID NO: 11898 - DNA, 20 bp, Artificial Sequence
  Description of Artificial Sequence: Synthetic oligonucleotide
gagggtgtcaggtcctgcct

SEQ ID NO: 11899 - DNA, 20 bp, Artificial Sequence
  Description of Artificial Sequence: Synthetic oligonucleotide
agggtgtcaggtcctgcctg

SEQ ID NO: 11900 - DNA, 20 bp, Artificial Sequence
  Description of Artificial Sequence: Synthetic oligonucleotide
gggtgtcaggtcctgcctgg

SEQ ID NO: 11901 - DNA, 20 bp, Artificial Sequence
  Description of Artificial Sequence: Synthetic oligonucleotide
ggtgtcaggtcctgcctggc

SEQ ID NO: 11902 - DNA, 20 bp, Artificial Sequence
  Description of Artificial Sequence: Synthetic oligonucleotide
gtgtcaggtcctgcctggcc

SEQ ID NO: 11903 - DNA, 20 bp, Artificial Sequence
  Description of Artificial Sequence: Synthetic oligonucleotide
tgtcaggtcctgcctggccc

SEQ ID NO: 11904 - DNA, 20 bp, Artificial Sequence
  Description of Artificial Sequence: Synthetic oligonucleotide
gtcaggtcctgcctggcccc

SEQ ID NO: 11905 - DNA, 20 bp, Artificial Sequence
  Description of Artificial Sequence: Synthetic oligonucleotide
tcaggtcctgcctggcccca

SEQ ID NO: 11906 - DNA, 20 bp, Artificial Sequence
  Description of Artificial Sequence: Synthetic oligonucleotide
caggtcctgcctggccccac

SEQ ID NO: 11907 - DNA, 20 bp, Artificial Sequence
  Description of Artificial Sequence: Synthetic oligonucleotide
aggtcctgcctggccccacg

SEQ ID NO: 11908 - DNA, 20 bp, Artificial Sequence
  Description of Artificial Sequence: Synthetic oligonucleotide
ggtcctgcctggccccacgt

SEQ ID NO: 11909 - DNA, 20 bp, Artificial Sequence
  Description of Artificial Sequence: Synthetic oligonucleotide
gtcctgcctggccccacgtc

SEQ ID NO: 11910 - DNA, 20 bp, Artificial Sequence
  Description of Artificial Sequence: Synthetic oligonucleotide
tcctgcctggccccacgtcc

SEQ ID NO: 11911 - DNA, 20 bp, Artificial Sequence
  Description of Artificial Sequence: Synthetic oligonucleotide
cctgcctggccccacgtccc

SEQ ID NO: 11912 - DNA, 20 bp, Artificial Sequence
  Description of Artificial Sequence: Synthetic oligonucleotide
ctgcctggccccacgtcccc

SEQ ID NO: 11913 - DNA, 20 bp, Artificial Sequence
  Description of Artificial Sequence: Synthetic oligonucleotide
tgcctggccccacgtcccca

SEQ ID NO: 11914 - DNA, 20 bp, Artificial Sequence
  Description of Artificial Sequence: Synthetic oligonucleotide
gcctggccccacgtccccag

SEQ ID NO: 11915 - DNA, 20 bp, Artificial Sequence
  Description of Artificial Sequence: Synthetic oligonucleotide
cctggccccacgtccccagc

SEQ ID NO: 11916 - DNA, 20 bp, Artificial Sequence
  Description of Artificial Sequence: Synthetic oligonucleotide
ctggccccacgtccccagcc

SEQ ID NO: 11917 - DNA, 20 bp, Artificial Sequence
  Description of Artificial Sequence: Synthetic oligonucleotide
tggccccacgtccccagcca

SEQ ID NO: 11918 - DNA, 20 bp, Artificial Sequence
  Description of Artificial Sequence: Synthetic oligonucleotide
ggccccacgtccccagccac

SEQ ID NO: 11919 - DNA, 20 bp, Artificial Sequence
  Description of Artificial Sequence: Synthetic oligonucleotide
gccccacgtccccagccaca

SEQ ID NO: 11920 - DNA, 20 bp, Artificial Sequence
  Description of Artificial Sequence: Synthetic oligonucleotide
ccccacgtccccagccacac

SEQ ID NO: 11921 - DNA, 20 bp, Artificial Sequence
  Description of Artificial Sequence: Synthetic oligonucleotide
cccacgtccccagccacacg

SEQ ID NO: 11922 - DNA, 20 bp, Artificial Sequence
  Description of Artificial Sequence: Synthetic oligonucleotide
ccacgtccccagccacacgt

SEQ ID NO: 11923 - DNA, 20 bp, Artificial Sequence
  Description of Artificial Sequence: Synthetic oligonucleotide
cacgtccccagccacacgtc

SEQ ID NO: 11924 - DNA, 20 bp, Artificial Sequence
  Description of Artificial Sequence: Synthetic oligonucleotide
acgtccccagccacacgtcc

SEQ ID NO: 11925 - DNA, 20 bp, Artificial Sequence
  Description of Artificial Sequence: Synthetic oligonucleotide
cgtccccagccacacgtcca

SEQ ID NO: 11926 - DNA, 20 bp, Artificial Sequence
  Description of Artificial Sequence: Synthetic oligonucleotide
gtccccagccacacgtccag

SEQ ID NO: 11927 - DNA, 20 bp, Artificial Sequence
  Description of Artificial Sequence: Synthetic oligonucleotide
tccccagccacacgtccagt

SEQ ID NO: 11928 - DNA, 20 bp, Artificial Sequence
  Description of Artificial Sequence: Synthetic oligonucleotide
ccccagccacacgtccagtt

SEQ ID NO: 11929 - DNA, 20 bp, Artificial Sequence
  Description of Artificial Sequence: Synthetic oligonucleotide
cccagccacacgtccagttc

SEQ ID NO: 11930 - DNA, 20 bp, Artificial Sequence
  Description of Artificial Sequence: Synthetic oligonucleotide
ccagccacacgtccagttct

SEQ ID NO: 11931 - DNA, 20 bp, Artificial Sequence
  Description of Artificial Sequence: Synthetic oligonucleotide
cagccacacgtccagttctc

SEQ ID NO: 11932 - DNA, 20 bp, Artificial Sequence
  Description of Artificial Sequence: Synthetic oligonucleotide
agccacacgtccagttctca

SEQ ID NO: 11933 - DNA, 20 bp, Artificial Sequence
  Description of Artificial Sequence: Synthetic oligonucleotide
gccacacgtccagttctcac

SEQ ID NO: 11934 - DNA, 20 bp, Artificial Sequence
  Description of Artificial Sequence: Synthetic oligonucleotide
ccacacgtccagttctcacc

SEQ ID NO: 11935 - DNA, 20 bp, Artificial Sequence
  Description of Artificial Sequence: Synthetic oligonucleotide
cacacgtccagttctcacca

SEQ ID NO: 11936 - DNA, 20 bp, Artificial Sequence
  Description of Artificial Sequence: Synthetic oligonucleotide
acacgtccagttctcaccac

SEQ ID NO: 11937 - DNA, 20 bp, Artificial Sequence
  Description of Artificial Sequence: Synthetic oligonucleotide
cacgtccagttctcaccacc

SEQ ID NO: 11938 - DNA, 20 bp, Artificial Sequence
  Description of Artificial Sequence: Synthetic oligonucleotide
acgtccagttctcaccacct

SEQ ID NO: 11939 - DNA, 20 bp, Artificial Sequence
  Description of Artificial Sequence: Synthetic oligonucleotide
cgtccagttctcaccacctc

SEQ ID NO: 11940 - DNA, 20 bp, Artificial Sequence
  Description of Artificial Sequence: Synthetic oligonucleotide
gtccagttctcaccacctcc

SEQ ID NO: 11941 - DNA, 20 bp, Artificial Sequence
  Description of Artificial Sequence: Synthetic oligonucleotide
tccagttctcaccacctccc

SEQ ID NO: 11942 - DNA, 20 bp, Artificial Sequence
  Description of Artificial Sequence: Synthetic oligonucleotide
ccagttctcaccacctccct

SEQ ID NO: 11943 - DNA, 20 bp, Artificial Sequence
  Description of Artificial Sequence: Synthetic oligonucleotide
cagttctcaccacctccctc

SEQ ID NO: 11944 - DNA, 20 bp, Artificial Sequence
  Description of Artificial Sequence: Synthetic oligonucleotide
agttctcaccacctccctct

SEQ ID NO: 11945 - DNA, 20 bp, Artificial Sequence
  Description of Artificial Sequence: Synthetic oligonucleotide
gttctcaccacctccctctc

SEQ ID NO: 11946 - DNA, 20 bp, Artificial Sequence
  Description of Artificial Sequence: Synthetic oligonucleotide
ttctcaccacctccctctca

SEQ ID NO: 11947 - DNA, 20 bp, Artificial Sequence
  Description of Artificial Sequence: Synthetic oligonucleotide
tctcaccacctccctctcaa

SEQ ID NO: 11948 - DNA, 20 bp, Artificial Sequence
  Description of Artificial Sequence: Synthetic oligonucleotide
ctcaccacctccctctcaac

SEQ ID NO: 11949 - DNA, 20 bp, Artificial Sequence
  Description of Artificial Sequence: Synthetic oligonucleotide
tcaccacctccctctcaacc

SEQ ID NO: 11950 - DNA, 20 bp, Artificial Sequence
  Description of Artificial Sequence: Synthetic oligonucleotide
caccacctccctctcaacct

SEQ ID NO: 11951 - DNA, 20 bp, Artificial Sequence
  Description of Artificial Sequence: Synthetic oligonucleotide
accacctccctctcaacctg

SEQ ID NO: 11952 - DNA, 20 bp, Artificial Sequence
  Description of Artificial Sequence: Synthetic oligonucleotide
ccacctccctctcaacctgg

SEQ ID NO: 11953 - DNA, 20 bp, Artificial Sequence
  Description of Artificial Sequence: Synthetic oligonucleotide
cacctccctctcaacctggg

SEQ ID NO: 11954 - DNA, 20 bp, Artificial Sequence
  Description of Artificial Sequence: Synthetic oligonucleotide
acctccctctcaacctgggg

SEQ ID NO: 11955 - DNA, 20 bp, Artificial Sequence
  Description of Artificial Sequence: Synthetic oligonucleotide
cctccctctcaacctggggt

SEQ ID NO: 11956 - DNA, 20 bp, Artificial Sequence
  Description of Artificial Sequence: Synthetic oligonucleotide
ctccctctcaacctggggtc

SEQ ID NO: 11957 - DNA, 20 bp, Artificial Sequence
  Description of Artificial Sequence: Synthetic oligonucleotide
tccctctcaacctggggtcc

SEQ ID NO: 11958 - DNA, 20 bp, Artificial Sequence
  Description of Artificial Sequence: Synthetic oligonucleotide
ccctctcaacctggggtcca

SEQ ID NO: 11959 - DNA, 20 bp, Artificial Sequence
  Description of Artificial Sequence: Synthetic oligonucleotide
cctctcaacctggggtccag

SEQ ID NO: 11960 - DNA, 20 bp, Artificial Sequence
  Description of Artificial Sequence: Synthetic oligonucleotide
ctctcaacctggggtccagc

SEQ ID NO: 11961 - DNA, 20 bp, Artificial Sequence
  Description of Artificial Sequence: Synthetic oligonucleotide
tctcaacctggggtccagct

SEQ ID NO: 11962 - DNA, 20 bp, Artificial Sequence
  Description of Artificial Sequence: Synthetic oligonucleotide
ctcaacctggggtccagcta

SEQ ID NO: 11963 - DNA, 20 bp, Artificial Sequence
  Description of Artificial Sequence: Synthetic oligonucleotide
tcaacctggggtccagctat

SEQ ID NO: 11964 - DNA, 20 bp, Artificial Sequence
  Description of Artificial Sequence: Synthetic oligonucleotide
caacctggggtccagctatc

SEQ ID NO: 11965 - DNA, 20 bp, Artificial Sequence
  Description of Artificial Sequence: Synthetic oligonucleotide
aacctggggtccagctatca

SEQ ID NO: 11966 - DNA, 20 bp, Artificial Sequence
  Description of Artificial Sequence: Synthetic oligonucleotide
acctggggtccagctatcag

SEQ ID NO: 11967 - DNA, 20 bp, Artificial Sequence
  Description of Artificial Sequence: Synthetic oligonucleotide
cctggggtccagctatcaga

SEQ ID NO: 11968 - DNA, 20 bp, Artificial Sequence
  Description of Artificial Sequence: Synthetic oligonucleotide
ctggggtccagctatcagag

SEQ ID NO: 11969 - DNA, 20 bp, Artificial Sequence
  Description of Artificial Sequence: Synthetic oligonucleotide
tggggtccagctatcagagg

SEQ ID NO: 11970 - DNA, 20 bp, Artificial Sequence
  Description of Artificial Sequence: Synthetic oligonucleotide
ggggtccagctatcagaggg

SEQ ID NO: 11971 - DNA, 20 bp, Artificial Sequence
  Description of Artificial Sequence: Synthetic oligonucleotide
gggtccagctatcagaggga

SEQ ID NO: 11972 - DNA, 20 bp, Artificial Sequence
  Description of Artificial Sequence: Synthetic oligonucleotide
ggtccagctatcagagggac

SEQ ID NO: 11973 - DNA, 20 bp, Artificial Sequence
  Description of Artificial Sequence: Synthetic oligonucleotide
gtccagctatcagagggacc

SEQ ID NO: 11974 - DNA, 20 bp, Artificial Sequence
  Description of Artificial Sequence: Synthetic oligonucleotide
tccagctatcagagggacct

SEQ ID NO: 11975 - DNA, 20 bp, Artificial Sequence
  Description of Artificial Sequence: Synthetic oligonucleotide
ccagctatcagagggacctt

SEQ ID NO: 11976 - DNA, 20 bp, Artificial Sequence
  Description of Artificial Sequence: Synthetic oligonucleotide
cagctatcagagggaccttt

SEQ ID NO: 11977 - DNA, 20 bp, Artificial Sequence
  Description of Artificial Sequence: Synthetic oligonucleotide
agctatcagagggacctttt

SEQ ID NO: 11978 - DNA, 20 bp, Artificial Sequence
  Description of Artificial Sequence: Synthetic oligonucleotide
gctatcagagggaccttttc

SEQ ID NO: 11979 - DNA, 20 bp, Artificial Sequence
  Description of Artificial Sequence: Synthetic oligonucleotide
ctatcagagggaccttttct

SEQ ID NO: 11980 - DNA, 20 bp, Artificial Sequence
  Description of Artificial Sequence: Synthetic oligonucleotide
tatcagagggaccttttctc

SEQ ID NO: 11981 - DNA, 20 bp, Artificial Sequence
  Description of Artificial Sequence: Synthetic oligonucleotide
atcagagggaccttttctcc

SEQ ID NO: 11982 - DNA, 20 bp, Artificial Sequence
  Description of Artificial Sequence: Synthetic oligonucleotide
tcagagggaccttttctccc

SEQ ID NO: 11983 - DNA, 20 bp, Artificial Sequence
  Description of Artificial Sequence: Synthetic oligonucleotide
cagagggaccttttctccct

SEQ ID NO: 11984 - DNA, 20 bp, Artificial Sequence
  Description of Artificial Sequence: Synthetic oligonucleotide
agagggaccttttctccctt

SEQ ID NO: 11985 - DNA, 20 bp, Artificial Sequence
  Description of Artificial Sequence: Synthetic oligonucleotide
gagggaccttttctcccttg

SEQ ID NO: 11986 - DNA, 20 bp, Artificial Sequence
  Description of Artificial Sequence: Synthetic oligonucleotide
agggaccttttctcccttga

SEQ ID NO: 11987 - DNA, 20 bp, Artificial Sequence
  Description of Artificial Sequence: Synthetic oligonucleotide
gggaccttttctcccttgat

SEQ ID NO: 11988 - DNA, 20 bp, Artificial Sequence
  Description of Artificial Sequence: Synthetic oligonucleotide
ggaccttttctcccttgatc

SEQ ID NO: 11989 - DNA, 20 bp, Artificial Sequence
  Description of Artificial Sequence: Synthetic oligonucleotide
gaccttttctcccttgatcc

SEQ ID NO: 11990 - DNA, 20 bp, Artificial Sequence
  Description of Artificial Sequence: Synthetic oligonucleotide
accttttctcccttgatcct

SEQ ID NO: 11991 - DNA, 20 bp, Artificial Sequence
  Description of Artificial Sequence: Synthetic oligonucleotide
ccttttctcccttgatccta

SEQ ID NO: 11992 - DNA, 20 bp, Artificial Sequence
  Description of Artificial Sequence: Synthetic oligonucleotide
cttttctcccttgatcctag

SEQ ID NO: 11993 - DNA, 20 bp, Artificial Sequence
  Description of Artificial Sequence: Synthetic oligonucleotide
ttttctcccttgatcctagg

SEQ ID NO: 11994 - DNA, 20 bp, Artificial Sequence
  Description of Artificial Sequence: Synthetic oligonucleotide
tttctcccttgatcctaggg

SEQ ID NO: 11995 - DNA, 20 bp, Artificial Sequence
  Description of Artificial Sequence: Synthetic oligonucleotide
ttctcccttgatcctagggt

SEQ ID NO: 11996 - DNA, 20 bp, Artificial Sequence
  Description of Artificial Sequence: Synthetic oligonucleotide
tctcccttgatcctagggtt

SEQ ID NO: 11997 - DNA, 20 bp, Artificial Sequence
  Description of Artificial Sequence: Synthetic oligonucleotide
ctcccttgatcctagggtta

SEQ ID NO: 11998 - DNA, 20 bp, Artificial Sequence
  Description of Artificial Sequence: Synthetic oligonucleotide
tcccttgatcctagggttac

SEQ ID NO: 11999 - DNA, 20 bp, Artificial Sequence
  Description of Artificial Sequence: Synthetic oligonucleotide
cccttgatcctagggttacc

SEQ ID NO: 12000 - DNA, 20 bp, Artificial Sequence
  Description of Artificial Sequence: Synthetic oligonucleotide
ccttgatcctagggttacct

SEQ ID NO: 12001 - DNA, 20 bp, Artificial Sequence
  Description of Artificial Sequence: Synthetic oligonucleotide
cttgatcctagggttacctg

SEQ ID NO: 12002 - DNA, 20 bp, Artificial Sequence
  Description of Artificial Sequence: Synthetic oligonucleotide
ttgatcctagggttacctgg

SEQ ID NO: 12003 - DNA, 20 bp, Artificial Sequence
  Description of Artificial Sequence: Synthetic oligonucleotide
tgatcctagggttacctggc

SEQ ID NO: 12004 - DNA, 20 bp, Artificial Sequence
  Description of Artificial Sequence: Synthetic oligonucleotide
gatcctagggttacctggct

SEQ ID NO: 12005 - DNA, 20 bp, Artificial Sequence
  Description of Artificial Sequence: Synthetic oligonucleotide
atcctagggttacctggctt

SEQ ID NO: 12006 - DNA, 20 bp, Artificial Sequence
  Description of Artificial Sequence: Synthetic oligonucleotide
tcctagggttacctggcttt

SEQ ID NO: 12007 - DNA, 20 bp, Artificial Sequence
  Description of Artificial Sequence: Synthetic oligonucleotide
cctagggttacctggctttg

SEQ ID NO: 12008 - DNA, 20 bp, Artificial Sequence
  Description of Artificial Sequence: Synthetic oligonucleotide
ctagggttacctggctttgc

SEQ ID NO: 12009 - DNA, 20 bp, Artificial Sequence
  Description of Artificial Sequence: Synthetic oligonucleotide
tagggttacctggctttgca

SEQ ID NO: 12010 - DNA, 20 bp, Artificial Sequence
  Description of Artificial Sequence: Synthetic oligonucleotide
agggttacctggctttgcag

SEQ ID NO: 12011 - DNA, 20 bp, Artificial Sequence
  Description of Artificial Sequence: Synthetic oligonucleotide
gggttacctggctttgcaga

SEQ ID NO: 12012 - DNA, 20 bp, Artificial Sequence
  Description of Artificial Sequence: Synthetic oligonucleotide
ggttacctggctttgcagat

SEQ ID NO: 12013 - DNA, 20 bp, Artificial Sequence
  Description of Artificial Sequence: Synthetic oligonucleotide
gttacctggctttgcagatg

SEQ ID NO: 12014 - DNA, 20 bp, Artificial Sequence
  Description of Artificial Sequence: Synthetic oligonucleotide
ttacctggctttgcagatgc

SEQ ID NO: 12015 - DNA, 20 bp, Artificial Sequence
  Description of Artificial Sequence: Synthetic oligonucleotide
tacctggctttgcagatgct

SEQ ID NO: 12016 - DNA, 20 bp, Artificial Sequence
  Description of Artificial Sequence: Synthetic oligonucleotide
acctggctttgcagatgctg

SEQ ID NO: 12017 - DNA, 20 bp, Artificial Sequence
  Description of Artificial Sequence: Synthetic oligonucleotide
cctggctttgcagatgctga

SEQ ID NO: 12018 - DNA, 20 bp, Artificial Sequence
  Description of Artificial Sequence: Synthetic oligonucleotide
ctggctttgcagatgctgaa

SEQ ID NO: 12019 - DNA, 20 bp, Artificial Sequence
  Description of Artificial Sequence: Synthetic oligonucleotide
tggctttgcagatgctgaat

SEQ ID NO: 12020 - DNA, 20 bp, Artificial Sequence
  Description of Artificial Sequence: Synthetic oligonucleotide
ggctttgcagatgctgaatt

SEQ ID NO: 12021 - DNA, 20 bp, Artificial Sequence
  Description of Artificial Sequence: Synthetic oligonucleotide
gctttgcagatgctgaattc

SEQ ID NO: 12022 - DNA, 20 bp, Artificial Sequence
  Description of Artificial Sequence: Synthetic oligonucleotide
ctttgcagatgctgaattcg

SEQ ID NO: 12023 - DNA, 20 bp, Artificial Sequence
  Description of Artificial Sequence: Synthetic oligonucleotide
tttgcagatgctgaattcgc

SEQ ID NO: 12024 - DNA, 20 bp, Artificial Sequence
  Description of Artificial Sequence: Synthetic oligonucleotide
ttgcagatgctgaattcgca

SEQ ID NO: 12025 - DNA, 20 bp, Artificial Sequence
  Description of Artificial Sequence: Synthetic oligonucleotide
tgcagatgctgaattcgcag

SEQ ID NO: 12026 - DNA, 20 bp, Artificial Sequence
  Description of Artificial Sequence: Synthetic oligonucleotide
gcagatgctgaattcgcagg

SEQ ID NO: 12027 - DNA, 20 bp, Artificial Sequence
  Description of Artificial Sequence: Synthetic oligonucleotide
cagatgctgaattcgcaggt

SEQ ID NO: 12028 - DNA, 20 bp, Artificial Sequence
  Description of Artificial Sequence: Synthetic oligonucleotide
agatgctgaattcgcaggtg

SEQ ID NO: 12029 - DNA, 20 bp, Artificial Sequence
  Description of Artificial Sequence: Synthetic oligonucleotide
gatgctgaattcgcaggtgc

SEQ ID NO: 12030 - DNA, 20 bp, Artificial Sequence
  Description of Artificial Sequence: Synthetic oligonucleotide
atgctgaattcgcaggtgct

SEQ ID NO: 12031 - DNA, 20 bp, Artificial Sequence
  Description of Artificial Sequence: Synthetic oligonucleotide
tgctgaattcgcaggtgctg

SEQ ID NO: 12032 - DNA, 20 bp, Artificial Sequence
  Description of Artificial Sequence: Synthetic oligonucleotide
gctgaattcgcaggtgctgc

SEQ ID NO: 12033 - DNA, 20 bp, Artificial Sequence
  Description of Artificial Sequence: Synthetic oligonucleotide
ctgaattcgcaggtgctgct

SEQ ID NO: 12034 - DNA, 20 bp, Artificial Sequence
  Description of Artificial Sequence: Synthetic oligonucleotide
tgaattcgcaggtgctgctt

SEQ ID NO: 12035 - DNA, 20 bp, Artificial Sequence
  Description of Artificial Sequence: Synthetic oligonucleotide
gaattcgcaggtgctgcttc

SEQ ID NO: 12036 - DNA, 20 bp, Artificial Sequence
  Description of Artificial Sequence: Synthetic oligonucleotide
aattcgcaggtgctgcttct

SEQ ID NO: 12037 - DNA, 20 bp, Artificial Sequence
  Description of Artificial Sequence: Synthetic oligonucleotide
attcgcaggtgctgcttctc

SEQ ID NO: 12038 - DNA, 20 bp, Artificial Sequence
  Description of Artificial Sequence: Synthetic oligonucleotide
ttcgcaggtgctgcttctcc

SEQ ID NO: 12039 - DNA, 20 bp, Artificial Sequence
  Description of Artificial Sequence: Synthetic oligonucleotide
tcgcaggtgctgcttctcca

SEQ ID NO: 12040 - DNA, 20 bp, Artificial Sequence
  Description of Artificial Sequence: Synthetic oligonucleotide
cgcaggtgctgcttctccag

SEQ ID NO: 12041 - DNA, 20 bp, Artificial Sequence
  Description of Artificial Sequence: Synthetic oligonucleotide
gcaggtgctgcttctccagg

SEQ ID NO: 12042 - DNA, 20 bp, Artificial Sequence
  Description of Artificial Sequence: Synthetic oligonucleotide
caggtgctgcttctccaggt

SEQ ID NO: 12043 - DNA, 20 bp, Artificial Sequence
  Description of Artificial Sequence: Synthetic oligonucleotide
aggtgctgcttctccaggtg

SEQ ID NO: 12044 - DNA, 20 bp, Artificial Sequence
  Description of Artificial Sequence: Synthetic oligonucleotide
ggtgctgcttctccaggtgc

SEQ ID NO: 12045 - DNA, 20 bp, Artificial Sequence
  Description of Artificial Sequence: Synthetic oligonucleotide
gtgctgcttctccaggtgcc

SEQ ID NO: 12046 - DNA, 20 bp, Artificial Sequence
  Description of Artificial Sequence: Synthetic oligonucleotide
tgctgcttctccaggtgccg

SEQ ID NO: 12047 - DNA, 20 bp, Artificial Sequence
  Description of Artificial Sequence: Synthetic oligonucleotide
gctgcttctccaggtgccgc

SEQ ID NO: 12048 - DNA, 20 bp, Artificial Sequence
  Description of Artificial Sequence: Synthetic oligonucleotide
ctgcttctccaggtgccgct

SEQ ID NO: 12049 - DNA, 20 bp, Artificial Sequence
  Description of Artificial Sequence: Synthetic oligonucleotide
tgcttctccaggtgccgctg

SEQ ID NO: 12050 - DNA, 20 bp, Artificial Sequence
  Description of Artificial Sequence: Synthetic oligonucleotide
gcttctccaggtgccgctgc

SEQ ID NO: 12051 - DNA, 20 bp, Artificial Sequence
  Description of Artificial Sequence: Synthetic oligonucleotide
cttctccaggtgccgctgct

SEQ ID NO: 12052 - DNA, 20 bp, Artificial Sequence
  Description of Artificial Sequence: Synthetic oligonucleotide
ttctccaggtgccgctgctg

SEQ ID NO: 12053 - DNA, 20 bp, Artificial Sequence
  Description of Artificial Sequence: Synthetic oligonucleotide
tctccaggtgccgctgctgc

SEQ ID NO: 12054 - DNA, 20 bp, Artificial Sequence
  Description of Artificial Sequence: Synthetic oligonucleotide
ctccaggtgccgctgctgct

SEQ ID NO: 12055 - DNA, 20 bp, Artificial Sequence
  Description of Artificial Sequence: Synthetic oligonucleotide
tccaggtgccgctgctgctg

SEQ ID NO: 12056 - DNA, 20 bp, Artificial Sequence
  Description of Artificial Sequence: Synthetic oligonucleotide
ccaggtgccgctgctgctgg

SEQ ID NO: 12057 - DNA, 20 bp, Artificial Sequence
  Description of Artificial Sequence: Synthetic oligonucleotide
caggtgccgctgctgctggg

SEQ ID NO: 12058 - DNA, 20 bp, Artificial Sequence
  Description of Artificial Sequence: Synthetic oligonucleotide
aggtgccgctgctgctgggc

SEQ ID NO: 12059 - DNA, 20 bp, Artificial Sequence
  Description of Artificial Sequence: Synthetic oligonucleotide
ggtgccgctgctgctgggcc

SEQ ID NO: 12060 - DNA, 20 bp, Artificial Sequence
  Description of Artificial Sequence: Synthetic oligonucleotide
gtgccgctgctgctgggcca

SEQ ID NO: 12061 - DNA, 20 bp, Artificial Sequence
  Description of Artificial Sequence: Synthetic oligonucleotide
tgccgctgctgctgggccac

SEQ ID NO: 12062 - DNA, 20 bp, Artificial Sequence
  Description of Artificial Sequence: Synthetic oligonucleotide
gccgctgctgctgggccacc

SEQ ID NO: 12063 - DNA, 20 bp, Artificial Sequence
  Description of Artificial Sequence: Synthetic oligonucleotide
ccgctgctgctgggccacct

SEQ ID NO: 12064 - DNA, 20 bp, Artificial Sequence
  Description of Artificial Sequence: Synthetic oligonucleotide
cgctgctgctgggccacctt

SEQ ID NO: 12065 - DNA, 20 bp, Artificial Sequence
  Description of Artificial Sequence: Synthetic oligonucleotide
gctgctgctgggccaccttg

SEQ ID NO: 12066 - DNA, 20 bp, Artificial Sequence
  Description of Artificial Sequence: Synthetic oligonucleotide
ctgctgctgggccaccttgt

SEQ ID NO: 12067 - DNA, 20 bp, Artificial Sequence
  Description of Artificial Sequence: Synthetic oligonucleotide
tgctgctgggccaccttgtg

SEQ ID NO: 12068 - DNA, 20 bp, Artificial Sequence
  Description of Artificial Sequence: Synthetic oligonucleotide
gctgctgggccaccttgtgg

SEQ ID NO: 12069 - DNA, 20 bp, Artificial Sequence
  Description of Artificial Sequence: Synthetic oligonucleotide
ctgctgggccaccttgtgga

SEQ ID NO: 12070 - DNA, 20 bp, Artificial Sequence
  Description of Artificial Sequence: Synthetic oligonucleotide
tgctgggccaccttgtggaa

SEQ ID NO: 12071 - DNA, 20 bp, Artificial Sequence
  Description of Artificial Sequence: Synthetic oligonucleotide
gctgggccaccttgtggaag

SEQ ID NO: 12072 - DNA, 20 bp, Artificial Sequence
  Description of Artificial Sequence: Synthetic oligonucleotide
ctgggccaccttgtggaaga

SEQ ID NO: 12073 - DNA, 20 bp, Artificial Sequence
  Description of Artificial Sequence: Synthetic oligonucleotide
tgggccaccttgtggaagag

SEQ ID NO: 12074 - DNA, 20 bp, Artificial Sequence
  Description of Artificial Sequence: Synthetic oligonucleotide
gggccaccttgtggaagagt

SEQ ID NO: 12075 - DNA, 20 bp, Artificial Sequence
  Description of Artificial Sequence: Synthetic oligonucleotide
ggccaccttgtggaagagtt

SEQ ID NO: 12076 - DNA, 20 bp, Artificial Sequence
  Description of Artificial Sequence: Synthetic oligonucleotide
gccaccttgtggaagagttg

SEQ ID NO: 12077 - DNA, 20 bp, Artificial Sequence
  Description of Artificial Sequence: Synthetic oligonucleotide
ccaccttgtggaagagttgc

SEQ ID NO: 12078 - DNA, 20 bp, Artificial Sequence
  Description of Artificial Sequence: Synthetic oligonucleotide
caccttgtggaagagttgct

SEQ ID NO: 12079 - DNA, 20 bp, Artificial Sequence
  Description of Artificial Sequence: Synthetic oligonucleotide
accttgtggaagagttgctg

SEQ ID NO: 12080 - DNA, 20 bp, Artificial Sequence
  Description of Artificial Sequence: Synthetic oligonucleotide
ccttgtggaagagttgctgg

SEQ ID NO: 12081 - DNA, 20 bp, Artificial Sequence
  Description of Artificial Sequence: Synthetic oligonucleotide
cttgtggaagagttgctgga

SEQ ID NO: 12082 - DNA, 20 bp, Artificial Sequence
  Description of Artificial Sequence: Synthetic oligonucleotide
ttgtggaagagttgctggat

SEQ ID NO: 12083 - DNA, 20 bp, Artificial Sequence
  Description of Artificial Sequence: Synthetic oligonucleotide
tgtggaagagttgctggatc

SEQ ID NO: 12084 - DNA, 20 bp, Artificial Sequence
  Description of Artificial Sequence: Synthetic oligonucleotide
gtggaagagttgctggatcc

SEQ ID NO: 12085 - DNA, 20 bp, Artificial Sequence
  Description of Artificial Sequence: Synthetic oligonucleotide
tggaagagttgctggatcct

SEQ ID NO: 12086 - DNA, 20 bp, Artificial Sequence
  Description of Artificial Sequence: Synthetic oligonucleotide
ggaagagttgctggatcctg

SEQ ID NO: 12087 - DNA, 20 bp, Artificial Sequence
  Description of Artificial Sequence: Synthetic oligonucleotide
gaagagttgctggatcctgc

SEQ ID NO: 12088 - DNA, 20 bp, Artificial Sequence
  Description of Artificial Sequence: Synthetic oligonucleotide
aagagttgctggatcctgct

SEQ ID NO: 12089 - DNA, 20 bp, Artificial Sequence
  Description of Artificial Sequence: Synthetic oligonucleotide
agagttgctggatcctgctg

SEQ ID NO: 12090 - DNA, 20 bp, Artificial Sequence
  Description of Artificial Sequence: Synthetic oligonucleotide
gagttgctggatcctgctgt

SEQ ID NO: 12091 - DNA, 20 bp, Artificial Sequence
  Description of Artificial Sequence: Synthetic oligonucleotide
agttgctggatcctgctgtt

SEQ ID NO: 12092 - DNA, 20 bp, Artificial Sequence
  Description of Artificial Sequence: Synthetic oligonucleotide
gttgctggatcctgctgttc

SEQ ID NO: 12093 - DNA, 20 bp, Artificial Sequence
  Description of Artificial Sequence: Synthetic oligonucleotide
ttgctggatcctgctgttct

SEQ ID NO: 12094 - DNA, 20 bp, Artificial Sequence
  Description of Artificial Sequence: Synthetic oligonucleotide
tgctggatcctgctgttctg

SEQ ID NO: 12095 - DNA, 20 bp, Artificial Sequence
  Description of Artificial Sequence: Synthetic oligonucleotide
gctggatcctgctgttctga

SEQ ID NO: 12096 - DNA, 20 bp, Artificial Sequence
  Description of Artificial Sequence: Synthetic oligonucleotide
ctggatcctgctgttctgag

SEQ ID NO: 12097 - DNA, 20 bp, Artificial Sequence
  Description of Artificial Sequence: Synthetic oligonucleotide
tggatcctgctgttctgagc

SEQ ID NO: 12098 - DNA, 20 bp, Artificial Sequence
  Description of Artificial Sequence: Synthetic oligonucleotide
ggatcctgctgttctgagcc

SEQ ID NO: 12099 - DNA, 20 bp, Artificial Sequence
  Description of Artificial Sequence: Synthetic oligonucleotide
gatcctgctgttctgagcct

SEQ ID NO: 12100 - DNA, 20 bp, Artificial Sequence
  Description of Artificial Sequence: Synthetic oligonucleotide
atcctgctgttctgagcctt

SEQ ID NO: 12101 - DNA, 20 bp, Artificial Sequence
  Description of Artificial Sequence: Synthetic oligonucleotide
tcctgctgttctgagccttg

SEQ ID NO: 12102 - DNA, 20 bp, Artificial Sequence
  Description of Artificial Sequence: Synthetic oligonucleotide
cctgctgttctgagccttga

SEQ ID NO: 12103 - DNA, 20 bp, Artificial Sequence
  Description of Artificial Sequence: Synthetic oligonucleotide
ctgctgttctgagccttgag

SEQ ID NO: 12104 - DNA, 20 bp, Artificial Sequence
  Description of Artificial Sequence: Synthetic oligonucleotide
tgctgttctgagccttgagt

SEQ ID NO: 12105 - DNA, 20 bp, Artificial Sequence
  Description of Artificial Sequence: Synthetic oligonucleotide
gctgttctgagccttgagtt

SEQ ID NO: 12106 - DNA, 20 bp, Artificial Sequence
  Description of Artificial Sequence: Synthetic oligonucleotide
ctgttctgagccttgagttg

SEQ ID NO: 12107 - DNA, 20 bp, Artificial Sequence
  Description of Artificial Sequence: Synthetic oligonucleotide
tgttctgagccttgagttgt

SEQ ID NO: 12108 - DNA, 20 bp, Artificial Sequence
  Description of Artificial Sequence: Synthetic oligonucleotide
gttctgagccttgagttgtg

SEQ ID NO: 12109 - DNA, 20 bp, Artificial Sequence
  Description of Artificial Sequence: Synthetic oligonucleotide
ttctgagccttgagttgtgt

SEQ ID NO: 12110 - DNA, 20 bp, Artificial Sequence
  Description of Artificial Sequence: Synthetic oligonucleotide
tctgagccttgagttgtgtc

SEQ ID NO: 12111 - DNA, 20 bp, Artificial Sequence
  Description of Artificial Sequence: Synthetic oligonucleotide
ctgagccttgagttgtgtct

SEQ ID NO: 12112 - DNA, 20 bp, Artificial Sequence
  Description of Artificial Sequence: Synthetic oligonucleotide
tgagccttgagttgtgtctg

SEQ ID NO: 12113 - DNA, 20 bp, Artificial Sequence
  Description of Artificial Sequence: Synthetic oligonucleotide
gagccttgagttgtgtctgg

SEQ ID NO: 12114 - DNA, 20 bp, Artificial Sequence
  Description of Artificial Sequence: Synthetic oligonucleotide
agccttgagttgtgtctggg

SEQ ID NO: 12115 - DNA, 20 bp, Artificial Sequence
  Description of Artificial Sequence: Synthetic oligonucleotide
gccttgagttgtgtctgggg

SEQ ID NO: 12116 - DNA, 20 bp, Artificial Sequence
  Description of Artificial Sequence: Synthetic oligonucleotide
ccttgagttgtgtctgggga

SEQ ID NO: 12117 - DNA, 20 bp, Artificial Sequence
  Description of Artificial Sequence: Synthetic oligonucleotide
cttgagttgtgtctggggag

SEQ ID NO: 12118 - DNA, 20 bp, Artificial Sequence
  Description of Artificial Sequence: Synthetic oligonucleotide
ttgagttgtgtctggggagg

SEQ ID NO: 12119 - DNA, 20 bp, Artificial Sequence
  Description of Artificial Sequence: Synthetic oligonucleotide
tgagttgtgtctggggaggg

SEQ ID NO: 12120 - DNA, 20 bp, Artificial Sequence
  Description of Artificial Sequence: Synthetic oligonucleotide
gagttgtgtctggggagggg

SEQ ID NO: 12121 - DNA, 20 bp, Artificial Sequence
  Description of Artificial Sequence: Synthetic oligonucleotide
agttgtgtctggggaggggt

SEQ ID NO: 12122 - DNA, 20 bp, Artificial Sequence
  Description of Artificial Sequence: Synthetic oligonucleotide
gttgtgtctggggaggggtg

SEQ ID NO: 12123 - DNA, 20 bp, Artificial Sequence
  Description of Artificial Sequence: Synthetic oligonucleotide
ttgtgtctggggaggggtga

SEQ ID NO: 12124 - DNA, 20 bp, Artificial Sequence
  Description of Artificial Sequence: Synthetic oligonucleotide
tgtgtctggggaggggtgaa

SEQ ID NO: 12125 - DNA, 20 bp, Artificial Sequence
  Description of Artificial Sequence: Synthetic oligonucleotide
gtgtctggggaggggtgaaa

SEQ ID NO: 12126 - DNA, 20 bp, Artificial Sequence
  Description of Artificial Sequence: Synthetic oligonucleotide
tgtctggggaggggtgaaaa

SEQ ID NO: 12127 - DNA, 20 bp, Artificial Sequence
  Description of Artificial Sequence: Synthetic oligonucleotide
gtctggggaggggtgaaaac

SEQ ID NO: 12128 - DNA, 20 bp, Artificial Sequence
  Description of Artificial Sequence: Synthetic oligonucleotide
tctggggaggggtgaaaacc

SEQ ID NO: 12129 - DNA, 20 bp, Artificial Sequence
  Description of Artificial Sequence: Synthetic oligonucleotide
ctggggaggggtgaaaacct

SEQ ID NO: 12130 - DNA, 20 bp, Artificial Sequence
  Description of Artificial Sequence: Synthetic oligonucleotide
tggggaggggtgaaaacctt

SEQ ID NO: 12131 - DNA, 20 bp, Artificial Sequence
  Description of Artificial Sequence: Synthetic oligonucleotide
ggggaggggtgaaaaccttg

SEQ ID NO: 12132 - DNA, 20 bp, Artificial Sequence
  Description of Artificial Sequence: Synthetic oligonucleotide
gggaggggtgaaaaccttgg

SEQ ID NO: 12133 - DNA, 20 bp, Artificial Sequence
  Description of Artificial Sequence: Synthetic oligonucleotide
ggaggggtgaaaaccttggt

SEQ ID NO: 12134 - DNA, 20 bp, Artificial Sequence
  Description of Artificial Sequence: Synthetic oligonucleotide
gaggggtgaaaaccttggtg

SEQ ID NO: 12135 - DNA, 20 bp, Artificial Sequence
  Description of Artificial Sequence: Synthetic oligonucleotide
aggggtgaaaaccttggtga

SEQ ID NO: 12136 - DNA, 20 bp, Artificial Sequence
  Description of Artificial Sequence: Synthetic oligonucleotide
ggggtgaaaaccttggtgag

SEQ ID NO: 12137 - DNA, 20 bp, Artificial Sequence
  Description of Artificial Sequence: Synthetic oligonucleotide
gggtgaaaaccttggtgagg

SEQ ID NO: 12138 - DNA, 20 bp, Artificial Sequence
  Description of Artificial Sequence: Synthetic oligonucleotide
ggtgaaaaccttggtgagga

SEQ ID NO: 12139 - DNA, 20 bp, Artificial Sequence
  Description of Artificial Sequence: Synthetic oligonucleotide
gtgaaaaccttggtgaggac

SEQ ID NO: 12140 - DNA, 20 bp, Artificial Sequence
  Description of Artificial Sequence: Synthetic oligonucleotide
tgaaaaccttggtgaggacc

SEQ ID NO: 12141 - DNA, 20 bp, Artificial Sequence
  Description of Artificial Sequence: Synthetic oligonucleotide
gaaaaccttggtgaggaccc

SEQ ID NO: 12142 - DNA, 20 bp, Artificial Sequence
  Description of Artificial Sequence: Synthetic oligonucleotide
aaaaccttggtgaggaccca

SEQ ID NO: 12143 - DNA, 20 bp, Artificial Sequence
  Description of Artificial Sequence: Synthetic oligonucleotide
aaaccttggtgaggacccag

SEQ ID NO: 12144 - DNA, 20 bp, Artificial Sequence
  Description of Artificial Sequence: Synthetic oligonucleotide
aaccttggtgaggacccagc

SEQ ID NO: 12145 - DNA, 20 bp, Artificial Sequence
  Description of Artificial Sequence: Synthetic oligonucleotide
accttggtgaggacccagct

SEQ ID NO: 12146 - DNA, 20 bp, Artificial Sequence
  Description of Artificial Sequence: Synthetic oligonucleotide
ccttggtgaggacccagctt

SEQ ID NO: 12147 - DNA, 20 bp, Artificial Sequence
  Description of Artificial Sequence: Synthetic oligonucleotide
cttggtgaggacccagcttg

SEQ ID NO: 12148 - DNA, 20 bp, Artificial Sequence
  Description of Artificial Sequence: Synthetic oligonucleotide
ttggtgaggacccagcttgc

SEQ ID NO: 12149 - DNA, 20 bp, Artificial Sequence
  Description of Artificial Sequence: Synthetic oligonucleotide
tggtgaggacccagcttgcc

SEQ ID NO: 12150 - DNA, 20 bp, Artificial Sequence
  Description of Artificial Sequence: Synthetic oligonucleotide
ggtgaggacccagcttgcct

SEQ ID NO: 12151 - DNA, 20 bp, Artificial Sequence
  Description of Artificial Sequence: Synthetic oligonucleotide
gtgaggacccagcttgccta

SEQ ID NO: 12152 - DNA, 20 bp, Artificial Sequence
  Description of Artificial Sequence: Synthetic oligonucleotide
tgaggacccagcttgcctac

SEQ ID NO: 12153 - DNA, 20 bp, Artificial Sequence
  Description of Artificial Sequence: Synthetic oligonucleotide
gaggacccagcttgcctacc

SEQ ID NO: 12154 - DNA, 20 bp, Artificial Sequence
  Description of Artificial Sequence: Synthetic oligonucleotide
aggacccagcttgcctaccc

SEQ ID NO: 12155 - DNA, 20 bp, Artificial Sequence
  Description of Artificial Sequence: Synthetic oligonucleotide
ggacccagcttgcctacccc

SEQ ID NO: 12156 - DNA, 20 bp, Artificial Sequence
  Description of Artificial Sequence: Synthetic oligonucleotide
gacccagcttgcctacccca

SEQ ID NO: 12157 - DNA, 20 bp, Artificial Sequence
  Description of Artificial Sequence: Synthetic oligonucleotide
acccagcttgcctaccccaa

SEQ ID NO: 12158 - DNA, 20 bp, Artificial Sequence
  Description of Artificial Sequence: Synthetic oligonucleotide
cccagcttgcctaccccaac

SEQ ID NO: 12159 - DNA, 20 bp, Artificial Sequence
  Description of Artificial Sequence: Synthetic oligonucleotide
ccagcttgcctaccccaacc

SEQ ID NO: 12160 - DNA, 20 bp, Artificial Sequence
  Description of Artificial Sequence: Synthetic oligonucleotide
cagcttgcctaccccaacct

SEQ ID NO: 12161 - DNA, 20 bp, Artificial Sequence
  Description of Artificial Sequence: Synthetic oligonucleotide
agcttgcctaccccaacctc

SEQ ID NO: 12162 - DNA, 20 bp, Artificial Sequence
  Description of Artificial Sequence: Synthetic oligonucleotide
gcttgcctaccccaacctct

SEQ ID NO: 12163 - DNA, 20 bp, Artificial Sequence
  Description of Artificial Sequence: Synthetic oligonucleotide
cttgcctaccccaacctctt

SEQ ID NO: 12164 - DNA, 20 bp, Artificial Sequence
  Description of Artificial Sequence: Synthetic oligonucleotide
ttgcctaccccaacctctta

SEQ ID NO: 12165 - DNA, 20 bp, Artificial Sequence
  Description of Artificial Sequence: Synthetic oligonucleotide
tgcctaccccaacctcttaa

SEQ ID NO: 12166 - DNA, 20 bp, Artificial Sequence
  Description of Artificial Sequence: Synthetic oligonucleotide
gcctaccccaacctcttaat

SEQ ID NO: 12167 - DNA, 20 bp, Artificial Sequence
  Description of Artificial Sequence: Synthetic oligonucleotide
cctaccccaacctcttaatt

SEQ ID NO: 12168 - DNA, 20 bp, Artificial Sequence
  Description of Artificial Sequence: Synthetic oligonucleotide
ctaccccaacctcttaattc

SEQ ID NO: 12169 - DNA, 20 bp, Artificial Sequence
  Description of Artificial Sequence: Synthetic oligonucleotide
taccccaacctcttaattca

SEQ ID NO: 12170 - DNA, 20 bp, Artificial Sequence
  Description of Artificial Sequence: Synthetic oligonucleotide
accccaacctcttaattcat

SEQ ID NO: 12171 - DNA, 20 bp, Artificial Sequence
  Description of Artificial Sequence: Synthetic oligonucleotide
ccccaacctcttaattcatc

SEQ ID NO: 12172 - DNA, 20 bp, Artificial Sequence
  Description of Artificial Sequence: Synthetic oligonucleotide
cccaacctcttaattcatcc

SEQ ID NO: 12173 - DNA, 20 bp, Artificial Sequence
  Description of Artificial Sequence: Synthetic oligonucleotide
ccaacctcttaattcatcca

SEQ ID NO: 12174 - DNA, 20 bp, Artificial Sequence
  Description of Artificial Sequence: Synthetic oligonucleotide
caacctcttaattcatccac

SEQ ID NO: 12175 - DNA, 20 bp, Artificial Sequence
  Description of Artificial Sequence: Synthetic oligonucleotide
aacctcttaattcatccact

SEQ ID NO: 12176 - DNA, 20 bp, Artificial Sequence
  Description of Artificial Sequence: Synthetic oligonucleotide
acctcttaattcatccactc

SEQ ID NO: 12177 - DNA, 20 bp, Artificial Sequence
  Description of Artificial Sequence: Synthetic oligonucleotide
cctcttaattcatccactca

SEQ ID NO: 12178 - DNA, 20 bp, Artificial Sequence
  Description of Artificial Sequence: Synthetic oligonucleotide
ctcttaattcatccactcat

SEQ ID NO: 12179 - DNA, 20 bp, Artificial Sequence
  Description of Artificial Sequence: Synthetic oligonucleotide
tcttaattcatccactcatc

SEQ ID NO: 12180 - DNA, 20 bp, Artificial Sequence
  Description of Artificial Sequence: Synthetic oligonucleotide
cttaattcatccactcatcc

SEQ ID NO: 12181 - DNA, 20 bp, Artificial Sequence
  Description of Artificial Sequence: Synthetic oligonucleotide
ttaattcatccactcatcca

SEQ ID NO: 12182 - DNA, 20 bp, Artificial Sequence
  Description of Artificial Sequence: Synthetic oligonucleotide
taattcatccactcatccat

SEQ ID NO: 12183 - DNA, 20 bp, Artificial Sequence
  Description of Artificial Sequence: Synthetic oligonucleotide
aattcatccactcatccatc

SEQ ID NO: 12184 - DNA, 20 bp, Artificial Sequence
  Description of Artificial Sequence: Synthetic oligonucleotide
attcatccactcatccatcc

SEQ ID NO: 12185 - DNA, 20 bp, Artificial Sequence
  Description of Artificial Sequence: Synthetic oligonucleotide
ttcatccactcatccatcct

SEQ ID NO: 12186 - DNA, 20 bp, Artificial Sequence
  Description of Artificial Sequence: Synthetic oligonucleotide
tcatccactcatccatcctt

SEQ ID NO: 12187 - DNA, 20 bp, Artificial Sequence
  Description of Artificial Sequence: Synthetic oligonucleotide
catccactcatccatccttc

SEQ ID NO: 12188 - DNA, 20 bp, Artificial Sequence
  Description of Artificial Sequence: Synthetic oligonucleotide
atccactcatccatccttcc

SEQ ID NO: 12189 - DNA, 20 bp, Artificial Sequence
  Description of Artificial Sequence: Synthetic oligonucleotide
tccactcatccatccttcca

SEQ ID NO: 12190 - DNA, 20 bp, Artificial Sequence
  Description of Artificial Sequence: Synthetic oligonucleotide
ccactcatccatccttccaa

SEQ ID NO: 12191 - DNA, 20 bp, Artificial Sequence
  Description of Artificial Sequence: Synthetic oligonucleotide
cactcatccatccttccaaa

SEQ ID NO: 12192 - DNA, 20 bp, Artificial Sequence
  Description of Artificial Sequence: Synthetic oligonucleotide
actcatccatccttccaaat

SEQ ID NO: 12193 - DNA, 20 bp, Artificial Sequence
  Description of Artificial Sequence: Synthetic oligonucleotide
ctcatccatccttccaaatc

SEQ ID NO: 12194 - DNA, 20 bp, Artificial Sequence
  Description of Artificial Sequence: Synthetic oligonucleotide
tcatccatccttccaaatct

SEQ ID NO: 12195 - DNA, 20 bp, Artificial Sequence
  Description of Artificial Sequence: Synthetic oligonucleotide
catccatccttccaaatctc

SEQ ID NO: 12196 - DNA, 20 bp, Artificial Sequence
  Description of Artificial Sequence: Synthetic oligonucleotide
atccatccttccaaatctcc

SEQ ID NO: 12197 - DNA, 20 bp, Artificial Sequence
  Description of Artificial Sequence: Synthetic oligonucleotide
tccatccttccaaatctcca

SEQ ID NO: 12198 - DNA, 20 bp, Artificial Sequence
  Description of Artificial Sequence: Synthetic oligonucleotide
ccatccttccaaatctccat

SEQ ID NO: 12199 - DNA, 20 bp, Artificial Sequence
  Description of Artificial Sequence: Synthetic oligonucleotide
catccttccaaatctccatc

SEQ ID NO: 12200 - DNA, 20 bp, Artificial Sequence
  Description of Artificial Sequence: Synthetic oligonucleotide
atccttccaaatctccatcc

SEQ ID NO: 12201 - DNA, 20 bp, Artificial Sequence
  Description of Artificial Sequence: Synthetic oligonucleotide
tccttccaaatctccatccg

SEQ ID NO: 12202 - DNA, 20 bp, Artificial Sequence
  Description of Artificial Sequence: Synthetic oligonucleotide
ccttccaaatctccatccgc

SEQ ID NO: 12203 - DNA, 20 bp, Artificial Sequence
  Description of Artificial Sequence: Synthetic oligonucleotide
cttccaaatctccatccgct

SEQ ID NO: 12204 - DNA, 20 bp, Artificial Sequence
  Description of Artificial Sequence: Synthetic oligonucleotide
ttccaaatctccatccgctg

SEQ ID NO: 12205 - DNA, 20 bp, Artificial Sequence
  Description of Artificial Sequence: Synthetic oligonucleotide
tccaaatctccatccgctga

SEQ ID NO: 12206 - DNA, 20 bp, Artificial Sequence
  Description of Artificial Sequence: Synthetic oligonucleotide
ccaaatctccatccgctgag

SEQ ID NO: 12207 - DNA, 20 bp, Artificial Sequence
  Description of Artificial Sequence: Synthetic oligonucleotide
caaatctccatccgctgagg

SEQ ID NO: 12208 - DNA, 20 bp, Artificial Sequence
  Description of Artificial Sequence: Synthetic oligonucleotide
aaatctccatccgctgaggc

SEQ ID NO: 12209 - DNA, 20 bp, Artificial Sequence
  Description of Artificial Sequence: Synthetic oligonucleotide
aatctccatccgctgaggcc

SEQ ID NO: 12210 - DNA, 20 bp, Artificial Sequence
  Description of Artificial Sequence: Synthetic oligonucleotide
atctccatccgctgaggcca

SEQ ID NO: 12211 - DNA, 20 bp, Artificial Sequence
  Description of Artificial Sequence: Synthetic oligonucleotide
tctccatccgctgaggccag

SEQ ID NO: 12212 - DNA, 20 bp, Artificial Sequence
  Description of Artificial Sequence: Synthetic oligonucleotide
ctccatccgctgaggccagg

SEQ ID NO: 12213 - DNA, 20 bp, Artificial Sequence
  Description of Artificial Sequence: Synthetic oligonucleotide
tccatccgctgaggccaggc

SEQ ID NO: 12214 - DNA, 20 bp, Artificial Sequence
  Description of Artificial Sequence: Synthetic oligonucleotide
ccatccgctgaggccaggca

SEQ ID NO: 12215 - DNA, 20 bp, Artificial Sequence
  Description of Artificial Sequence: Synthetic oligonucleotide
catccgctgaggccaggcaa

SEQ ID NO: 12216 - DNA, 20 bp, Artificial Sequence
  Description of Artificial Sequence: Synthetic oligonucleotide
atccgctgaggccaggcaag

SEQ ID NO: 12217 - DNA, 20 bp, Artificial Sequence
  Description of Artificial Sequence: Synthetic oligonucleotide
tccgctgaggccaggcaagg

SEQ ID NO: 12218 - DNA, 20 bp, Artificial Sequence
  Description of Artificial Sequence: Synthetic oligonucleotide
ccgctgaggccaggcaaggg

SEQ ID NO: 12219 - DNA, 20 bp, Artificial Sequence
  Description of Artificial Sequence: Synthetic oligonucleotide
cgctgaggccaggcaaggga

SEQ ID NO: 12220 - DNA, 20 bp, Artificial Sequence
  Description of Artificial Sequence: Synthetic oligonucleotide
gctgaggccaggcaagggag

SEQ ID NO: 12221 - DNA, 20 bp, Artificial Sequence
  Description of Artificial Sequence: Synthetic oligonucleotide
ctgaggccaggcaagggagt

SEQ ID NO: 12222 - DNA, 20 bp, Artificial Sequence
  Description of Artificial Sequence: Synthetic oligonucleotide
tgaggccaggcaagggagtc

SEQ ID NO: 12223 - DNA, 20 bp, Artificial Sequence
  Description of Artificial Sequence: Synthetic oligonucleotide
gaggccaggcaagggagtct

SEQ ID NO: 12224 - DNA, 20 bp, Artificial Sequence
  Description of Artificial Sequence: Synthetic oligonucleotide
aggccaggcaagggagtctt

SEQ ID NO: 12225 - DNA, 20 bp, Artificial Sequence
  Description of Artificial Sequence: Synthetic oligonucleotide
ggccaggcaagggagtcttt

SEQ ID NO: 12226 - DNA, 20 bp, Artificial Sequence
  Description of Artificial Sequence: Synthetic oligonucleotide
gccaggcaagggagtctttc

SEQ ID NO: 12227 - DNA, 20 bp, Artificial Sequence
  Description of Artificial Sequence: Synthetic oligonucleotide
ccaggcaagggagtctttct

SEQ ID NO: 12228 - DNA, 20 bp, Artificial Sequence
  Description of Artificial Sequence: Synthetic oligonucleotide
caggcaagggagtctttctt

SEQ ID NO: 12229 - DNA, 20 bp, Artificial Sequence
  Description of Artificial Sequence: Synthetic oligonucleotide
aggcaagggagtctttcttt

SEQ ID NO: 12230 - DNA, 20 bp, Artificial Sequence
  Description of Artificial Sequence: Synthetic oligonucleotide
ggcaagggagtctttctttt

SEQ ID NO: 12231 - DNA, 20 bp, Artificial Sequence
  Description of Artificial Sequence: Synthetic oligonucleotide
gcaagggagtctttcttttt

SEQ ID NO: 12232 - DNA, 20 bp, Artificial Sequence
  Description of Artificial Sequence: Synthetic oligonucleotide
caagggagtctttctttttt

SEQ ID NO: 12233 - DNA, 20 bp, Artificial Sequence
  Description of Artificial Sequence: Synthetic oligonucleotide
aagggagtctttcttttttc

SEQ ID NO: 12234 - DNA, 20 bp, Artificial Sequence
  Description of Artificial Sequence: Synthetic oligonucleotide
agggagtctttcttttttct

SEQ ID NO: 12235 - DNA, 20 bp, Artificial Sequence
  Description of Artificial Sequence: Synthetic oligonucleotide
gggagtctttcttttttctt

SEQ ID NO: 12236 - DNA, 20 bp, Artificial Sequence
  Description of Artificial Sequence: Synthetic oligonucleotide
ggagtctttcttttttcttt

SEQ ID NO: 12237 - DNA, 20 bp, Artificial Sequence
  Description of Artificial Sequence: Synthetic oligonucleotide
gagtctttcttttttctttt

SEQ ID NO: 12238 - DNA, 20 bp, Artificial Sequence
  Description of Artificial Sequence: Synthetic oligonucleotide
agtctttcttttttcttttt

SEQ ID NO: 12239 - DNA, 20 bp, Artificial Sequence
  Description of Artificial Sequence: Synthetic oligonucleotide
gtctttcttttttctttttt

SEQ ID NO: 12240 - DNA, 20 bp, Artificial Sequence
  Description of Artificial Sequence: Synthetic oligonucleotide
tctttcttttttcttttttt

SEQ ID NO: 12241 - DNA, 20 bp, Artificial Sequence
  Description of Artificial Sequence: Synthetic oligonucleotide
ctttcttttttctttttttt

SEQ ID NO: 12242 - DNA, 20 bp, Artificial Sequence
  Description of Artificial Sequence: Synthetic oligonucleotide
tttcttttttcttttttttc

SEQ ID NO: 12243 - DNA, 20 bp, Artificial Sequence
  Description of Artificial Sequence: Synthetic oligonucleotide
ttcttttttcttttttttcc

SEQ ID NO: 12244 - DNA, 20 bp, Artificial Sequence
  Description of Artificial Sequence: Synthetic oligonucleotide
tcttttttcttttttttccc

SEQ ID NO: 12245 - DNA, 20 bp, Artificial Sequence
  Description of Artificial Sequence: Synthetic oligonucleotide
cttttttcttttttttccca

SEQ ID NO: 12246 - DNA, 20 bp, Artificial Sequence
  Description of Artificial Sequence: Synthetic oligonucleotide
ttttttcttttttttcccaa

SEQ ID NO: 12247 - DNA, 20 bp, Artificial Sequence
  Description of Artificial Sequence: Synthetic oligonucleotide
tttttcttttttttcccaat

SEQ ID NO: 12248 - DNA, 20 bp, Artificial Sequence
  Description of Artificial Sequence: Synthetic oligonucleotide
ttttcttttttttcccaatg

SEQ ID NO: 12249 - DNA, 20 bp, Artificial Sequence
  Description of Artificial Sequence: Synthetic oligonucleotide
tttcttttttttcccaatga

SEQ ID NO: 12250 - DNA, 20 bp, Artificial Sequence
  Description of Artificial Sequence: Synthetic oligonucleotide
ttcttttttttcccaatgac

SEQ ID NO: 12251 - DNA, 20 bp, Artificial Sequence
  Description of Artificial Sequence: Synthetic oligonucleotide
tcttttttttcccaatgacg

SEQ ID NO: 12252 - DNA, 20 bp, Artificial Sequence
  Description of Artificial Sequence: Synthetic oligonucleotide
cttttttttcccaatgacgg

SEQ ID NO: 12253 - DNA, 20 bp, Artificial Sequence
  Description of Artificial Sequence: Synthetic oligonucleotide
ttttttttcccaatgacggg

SEQ ID NO: 12254 - DNA, 20 bp, Artificial Sequence
  Description of Artificial Sequence: Synthetic oligonucleotide
tttttttcccaatgacgggg

SEQ ID NO: 12255 - DNA, 20 bp, Artificial Sequence
  Description of Artificial Sequence: Synthetic oligonucleotide
ttttttcccaatgacggggt

SEQ ID NO: 12256 - DNA, 20 bp, Artificial Sequence
  Description of Artificial Sequence: Synthetic oligonucleotide
tttttcccaatgacggggtc

SEQ ID NO: 12257 - DNA, 20 bp, Artificial Sequence
  Description of Artificial Sequence: Synthetic oligonucleotide
ttttcccaatgacggggtct

SEQ ID NO: 12258 - DNA, 20 bp, Artificial Sequence
  Description of Artificial Sequence: Synthetic oligonucleotide
tttcccaatgacggggtctc

SEQ ID NO: 12259 - DNA, 20 bp, Artificial Sequence
  Description of Artificial Sequence: Synthetic oligonucleotide
ttcccaatgacggggtctcg

SEQ ID NO: 12260 - DNA, 20 bp, Artificial Sequence
  Description of Artificial Sequence: Synthetic oligonucleotide
tcccaatgacggggtctcgt

SEQ ID NO: 12261 - DNA, 20 bp, Artificial Sequence
  Description of Artificial Sequence: Synthetic oligonucleotide
cccaatgacggggtctcgtt

SEQ ID NO: 12262 - DNA, 20 bp, Artificial Sequence
  Description of Artificial Sequence: Synthetic oligonucleotide
ccaatgacggggtctcgttc

SEQ ID NO: 12263 - DNA, 20 bp, Artificial Sequence
  Description of Artificial Sequence: Synthetic oligonucleotide
caatgacggggtctcgttct

SEQ ID NO: 12264 - DNA, 20 bp, Artificial Sequence
  Description of Artificial Sequence: Synthetic oligonucleotide
aatgacggggtctcgttctc

SEQ ID NO: 12265 - DNA, 20 bp, Artificial Sequence
  Description of Artificial Sequence: Synthetic oligonucleotide
atgacggggtctcgttctct

SEQ ID NO: 12266 - DNA, 20 bp, Artificial Sequence
  Description of Artificial Sequence: Synthetic oligonucleotide
tgacggggtctcgttctctc

SEQ ID NO: 12267 - DNA, 20 bp, Artificial Sequence
  Description of Artificial Sequence: Synthetic oligonucleotide
gacggggtctcgttctctcg

SEQ ID NO: 12268 - DNA, 20 bp, Artificial Sequence
  Description of Artificial Sequence: Synthetic oligonucleotide
acggggtctcgttctctcgc

SEQ ID NO: 12269 - DNA, 20 bp, Artificial Sequence
  Description of Artificial Sequence: Synthetic oligonucleotide
cggggtctcgttctctcgcc

SEQ ID NO: 12270 - DNA, 20 bp, Artificial Sequence
  Description of Artificial Sequence: Synthetic oligonucleotide
ggggtctcgttctctcgccc

SEQ ID NO: 12271 - DNA, 20 bp, Artificial Sequence
  Description of Artificial Sequence: Synthetic oligonucleotide
gggtctcgttctctcgccca

SEQ ID NO: 12272 - DNA, 20 bp, Artificial Sequence
  Description of Artificial Sequence: Synthetic oligonucleotide
ggtctcgttctctcgcccag

SEQ ID NO: 12273 - DNA, 20 bp, Artificial Sequence
  Description of Artificial Sequence: Synthetic oligonucleotide
gtctcgttctctcgcccagg

SEQ ID NO: 12274 - DNA, 20 bp, Artificial Sequence
  Description of Artificial Sequence: Synthetic oligonucleotide
tctcgttctctcgcccaggc

SEQ ID NO: 12275 - DNA, 20 bp, Artificial Sequence
  Description of Artificial Sequence: Synthetic oligonucleotide
ctcgttctctcgcccaggct

SEQ ID NO: 12276 - DNA, 20 bp, Artificial Sequence
  Description of Artificial Sequence: Synthetic oligonucleotide
tcgttctctcgcccaggctg

SEQ ID NO: 12277 - DNA, 20 bp, Artificial Sequence
  Description of Artificial Sequence: Synthetic oligonucleotide
cgttctctcgcccaggctgg

SEQ ID NO: 12278 - DNA, 20 bp, Artificial Sequence
  Description of Artificial Sequence: Synthetic oligonucleotide
gttctctcgcccaggctgga

SEQ ID NO: 12279 - DNA, 20 bp, Artificial Sequence
  Description of Artificial Sequence: Synthetic oligonucleotide
ttctctcgcccaggctggag

SEQ ID NO: 12280 - DNA, 20 bp, Artificial Sequence
  Description of Artificial Sequence: Synthetic oligonucleotide
tctctcgcccaggctggagt

SEQ ID NO: 12281 - DNA, 20 bp, Artificial Sequence
  Description of Artificial Sequence: Synthetic oligonucleotide
ctctcgcccaggctggagtg

SEQ ID NO: 12282 - DNA, 20 bp, Artificial Sequence
  Description of Artificial Sequence: Synthetic oligonucleotide
tctcgcccaggctggagtgc

SEQ ID NO: 12283 - DNA, 20 bp, Artificial Sequence
  Description of Artificial Sequence: Synthetic oligonucleotide
ctcgcccaggctggagtgca

SEQ ID NO: 12284 - DNA, 20 bp, Artificial Sequence
  Description of Artificial Sequence: Synthetic oligonucleotide
tcgcccaggctggagtgcag

SEQ ID NO: 12285 - DNA, 20 bp, Artificial Sequence
  Description of Artificial Sequence: Synthetic oligonucleotide
cgcccaggctggagtgcagt

SEQ ID NO: 12286 - DNA, 20 bp, Artificial Sequence
  Description of Artificial Sequence: Synthetic oligonucleotide
gcccaggctggagtgcagtg

SEQ ID NO: 12287 - DNA, 20 bp, Artificial Sequence
  Description of Artificial Sequence: Synthetic oligonucleotide
cccaggctggagtgcagtgg

SEQ ID NO: 12288 - DNA, 20 bp, Artificial Sequence
  Description of Artificial Sequence: Synthetic oligonucleotide
ccaggctggagtgcagtggt

SEQ ID NO: 12289 - DNA, 20 bp, Artificial Sequence
  Description of Artificial Sequence: Synthetic oligonucleotide
caggctggagtgcagtggtg

SEQ ID NO: 12290 - DNA, 20 bp, Artificial Sequence
  Description of Artificial Sequence: Synthetic oligonucleotide
aggctggagtgcagtggtgc

SEQ ID NO: 12291 - DNA, 20 bp, Artificial Sequence
  Description of Artificial Sequence: Synthetic oligonucleotide
ggctggagtgcagtggtgct

SEQ ID NO: 12292 - DNA, 20 bp, Artificial Sequence
  Description of Artificial Sequence: Synthetic oligonucleotide
gctggagtgcagtggtgctg

SEQ ID NO: 12293 - DNA, 20 bp, Artificial Sequence
  Description of Artificial Sequence: Synthetic oligonucleotide
ctggagtgcagtggtgctgt

SEQ ID NO: 12294 - DNA, 20 bp, Artificial Sequence
  Description of Artificial Sequence: Synthetic oligonucleotide
tggagtgcagtggtgctgtc

SEQ ID NO: 12295 - DNA, 20 bp, Artificial Sequence
  Description of Artificial Sequence: Synthetic oligonucleotide
ggagtgcagtggtgctgtca

SEQ ID NO: 12296 - DNA, 20 bp, Artificial Sequence
  Description of Artificial Sequence: Synthetic oligonucleotide
gagtgcagtggtgctgtcac

SEQ ID NO: 12297 - DNA, 20 bp, Artificial Sequence
  Description of Artificial Sequence: Synthetic oligonucleotide
agtgcagtggtgctgtcaca

SEQ ID NO: 12298 - DNA, 20 bp, Artificial Sequence
  Description of Artificial Sequence: Synthetic oligonucleotide
gtgcagtggtgctgtcacag

SEQ ID NO: 12299 - DNA, 20 bp, Artificial Sequence
  Description of Artificial Sequence: Synthetic oligonucleotide
tgcagtggtgctgtcacagc

SEQ ID NO: 12300 - DNA, 20 bp, Artificial Sequence
  Description of Artificial Sequence: Synthetic oligonucleotide
gcagtggtgctgtcacagct

SEQ ID NO: 12301 - DNA, 20 bp, Artificial Sequence
  Description of Artificial Sequence: Synthetic oligonucleotide
cagtggtgctgtcacagctc

SEQ ID NO: 12302 - DNA, 20 bp, Artificial Sequence
  Description of Artificial Sequence: Synthetic oligonucleotide
agtggtgctgtcacagctca

SEQ ID NO: 12303 - DNA, 20 bp, Artificial Sequence
  Description of Artificial Sequence: Synthetic oligonucleotide
gtggtgctgtcacagctcac

SEQ ID NO: 12304 - DNA, 20 bp, Artificial Sequence
  Description of Artificial Sequence: Synthetic oligonucleotide
tggtgctgtcacagctcact

SEQ ID NO: 12305 - DNA, 20 bp, Artificial Sequence
  Description of Artificial Sequence: Synthetic oligonucleotide
ggtgctgtcacagctcactg

SEQ ID NO: 12306 - DNA, 20 bp, Artificial Sequence
  Description of Artificial Sequence: Synthetic oligonucleotide
gtgctgtcacagctcactgc

SEQ ID NO: 12307 - DNA, 20 bp, Artificial Sequence
  Description of Artificial Sequence: Synthetic oligonucleotide
tgctgtcacagctcactgca

SEQ ID NO: 12308 - DNA, 20 bp, Artificial Sequence
  Description of Artificial Sequence: Synthetic oligonucleotide
gctgtcacagctcactgcag

SEQ ID NO: 12309 - DNA, 20 bp, Artificial Sequence
  Description of Artificial Sequence: Synthetic oligonucleotide
ctgtcacagctcactgcagc

SEQ ID NO: 12310 - DNA, 20 bp, Artificial Sequence
  Description of Artificial Sequence: Synthetic oligonucleotide
tgtcacagctcactgcagcc

SEQ ID NO: 12311 - DNA, 20 bp, Artificial Sequence
  Description of Artificial Sequence: Synthetic oligonucleotide
gtcacagctcactgcagcct

SEQ ID NO: 12312 - DNA, 20 bp, Artificial Sequence
  Description of Artificial Sequence: Synthetic oligonucleotide
tcacagctcactgcagcctc

SEQ ID NO: 12313 - DNA, 20 bp, Artificial Sequence
  Description of Artificial Sequence: Synthetic oligonucleotide
cacagctcactgcagcctcc

SEQ ID NO: 12314 - DNA, 20 bp, Artificial Sequence
  Description of Artificial Sequence: Synthetic oligonucleotide
acagctcactgcagcctcca

SEQ ID NO: 12315 - DNA, 20 bp, Artificial Sequence
  Description of Artificial Sequence: Synthetic oligonucleotide
cagctcactgcagcctccaa

SEQ ID NO: 12316 - DNA, 20 bp, Artificial Sequence
  Description of Artificial Sequence: Synthetic oligonucleotide
agctcactgcagcctccaac

SEQ ID NO: 12317 - DNA, 20 bp, Artificial Sequence
  Description of Artificial Sequence: Synthetic oligonucleotide
gctcactgcagcctccaact

SEQ ID NO: 12318 - DNA, 20 bp, Artificial Sequence
  Description of Artificial Sequence: Synthetic oligonucleotide
ctcactgcagcctccaactc

SEQ ID NO: 12319 - DNA, 20 bp, Artificial Sequence
  Description of Artificial Sequence: Synthetic oligonucleotide
tcactgcagcctccaactcc

SEQ ID NO: 12320 - DNA, 20 bp, Artificial Sequence
  Description of Artificial Sequence: Synthetic oligonucleotide
cactgcagcctccaactcct

SEQ ID NO: 12321 - DNA, 20 bp, Artificial Sequence
  Description of Artificial Sequence: Synthetic oligonucleotide
actgcagcctccaactcctg

SEQ ID NO: 12322 - DNA, 20 bp, Artificial Sequence
  Description of Artificial Sequence: Synthetic oligonucleotide
ctgcagcctccaactcctgg

SEQ ID NO: 12323 - DNA, 20 bp, Artificial Sequence
  Description of Artificial Sequence: Synthetic oligonucleotide
tgcagcctccaactcctggg

SEQ ID NO: 12324 - DNA, 20 bp, Artificial Sequence
  Description of Artificial Sequence: Synthetic oligonucleotide
gcagcctccaactcctgggg

SEQ ID NO: 12325 - DNA, 20 bp, Artificial Sequence
  Description of Artificial Sequence: Synthetic oligonucleotide
cagcctccaactcctggggt

SEQ ID NO: 12326 - DNA, 20 bp, Artificial Sequence
  Description of Artificial Sequence: Synthetic oligonucleotide
agcctccaactcctggggtc

SEQ ID NO: 12327 - DNA, 20 bp, Artificial Sequence
  Description of Artificial Sequence: Synthetic oligonucleotide
gcctccaactcctggggtca

SEQ ID NO: 12328 - DNA, 20 bp, Artificial Sequence
  Description of Artificial Sequence: Synthetic oligonucleotide
cctccaactcctggggtcag

SEQ ID NO: 12329 - DNA, 20 bp, Artificial Sequence
  Description of Artificial Sequence: Synthetic oligonucleotide
ctccaactcctggggtcagg

SEQ ID NO: 12330 - DNA, 20 bp, Artificial Sequence
  Description of Artificial Sequence: Synthetic oligonucleotide
tccaactcctggggtcaggc

SEQ ID NO: 12331 - DNA, 20 bp, Artificial Sequence
  Description of Artificial Sequence: Synthetic oligonucleotide
ccaactcctggggtcaggcg

SEQ ID NO: 12332 - DNA, 20 bp, Artificial Sequence
  Description of Artificial Sequence: Synthetic oligonucleotide
caactcctggggtcaggcga

SEQ ID NO: 12333 - DNA, 20 bp, Artificial Sequence
  Description of Artificial Sequence: Synthetic oligonucleotide
aactcctggggtcaggcgat

SEQ ID NO: 12334 - DNA, 20 bp, Artificial Sequence
  Description of Artificial Sequence: Synthetic oligonucleotide
actcctggggtcaggcgatc

SEQ ID NO: 12335 - DNA, 20 bp, Artificial Sequence
  Description of Artificial Sequence: Synthetic oligonucleotide
ctcctggggtcaggcgatcc

SEQ ID NO: 12336 - DNA, 20 bp, Artificial Sequence
  Description of Artificial Sequence: Synthetic oligonucleotide
tcctggggtcaggcgatcct

SEQ ID NO: 12337 - DNA, 20 bp, Artificial Sequence
  Description of Artificial Sequence: Synthetic oligonucleotide
cctggggtcaggcgatcctc

SEQ ID NO: 12338 - DNA, 20 bp, Artificial Sequence
  Description of Artificial Sequence: Synthetic oligonucleotide
ctggggtcaggcgatcctcc

SEQ ID NO: 12339 - DNA, 20 bp, Artificial Sequence
  Description of Artificial Sequence: Synthetic oligonucleotide
tggggtcaggcgatcctcct

SEQ ID NO: 12340 - DNA, 20 bp, Artificial Sequence
  Description of Artificial Sequence: Synthetic oligonucleotide
ggggtcaggcgatcctcctg

SEQ ID NO: 12341 - DNA, 20 bp, Artificial Sequence
  Description of Artificial Sequence: Synthetic oligonucleotide
gggtcaggcgatcctcctgt

SEQ ID NO: 12342 - DNA, 20 bp, Artificial Sequence
  Description of Artificial Sequence: Synthetic oligonucleotide
ggtcaggcgatcctcctgtt

SEQ ID NO: 12343 - DNA, 20 bp, Artificial Sequence
  Description of Artificial Sequence: Synthetic oligonucleotide
gtcaggcgatcctcctgttt

SEQ ID NO: 12344 - DNA, 20 bp, Artificial Sequence
  Description of Artificial Sequence: Synthetic oligonucleotide
tcaggcgatcctcctgtttt

SEQ ID NO: 12345 - DNA, 20 bp, Artificial Sequence
  Description of Artificial Sequence: Synthetic oligonucleotide
caggcgatcctcctgttttc

SEQ ID NO: 12346 - DNA, 20 bp, Artificial Sequence
  Description of Artificial Sequence: Synthetic oligonucleotide
aggcgatcctcctgttttca

SEQ ID NO: 12347 - DNA, 20 bp, Artificial Sequence
  Description of Artificial Sequence: Synthetic oligonucleotide
ggcgatcctcctgttttcag

SEQ ID NO: 12348 - DNA, 20 bp, Artificial Sequence
  Description of Artificial Sequence: Synthetic oligonucleotide
gcgatcctcctgttttcagc

SEQ ID NO: 12349 - DNA, 20 bp, Artificial Sequence
  Description of Artificial Sequence: Synthetic oligonucleotide
cgatcctcctgttttcagcc

SEQ ID NO: 12350 - DNA, 20 bp, Artificial Sequence
  Description of Artificial Sequence: Synthetic oligonucleotide
gatcctcctgttttcagcct

SEQ ID NO: 12351 - DNA, 20 bp, Artificial Sequence
  Description of Artificial Sequence: Synthetic oligonucleotide
atcctcctgttttcagcctc

SEQ ID NO: 12352 - DNA, 20 bp, Artificial Sequence
  Description of Artificial Sequence: Synthetic oligonucleotide
tcctcctgttttcagcctcc

SEQ ID NO: 12353 - DNA, 20 bp, Artificial Sequence
  Description of Artificial Sequence: Synthetic oligonucleotide
cctcctgttttcagcctcct

SEQ ID NO: 12354 - DNA, 20 bp, Artificial Sequence
  Description of Artificial Sequence: Synthetic oligonucleotide
ctcctgttttcagcctcctg

SEQ ID NO: 12355 - DNA, 20 bp, Artificial Sequence
  Description of Artificial Sequence: Synthetic oligonucleotide
tcctgttttcagcctcctgt

SEQ ID NO: 12356 - DNA, 20 bp, Artificial Sequence
  Description of Artificial Sequence: Synthetic oligonucleotide
cctgttttcagcctcctgtg

SEQ ID NO: 12357 - DNA, 20 bp, Artificial Sequence
  Description of Artificial Sequence: Synthetic oligonucleotide
ctgttttcagcctcctgtgt

SEQ ID NO: 12358 - DNA, 20 bp, Artificial Sequence
  Description of Artificial Sequence: Synthetic oligonucleotide
tgttttcagcctcctgtgta

SEQ ID NO: 12359 - DNA, 20 bp, Artificial Sequence
  Description of Artificial Sequence: Synthetic oligonucleotide
gttttcagcctcctgtgtag

SEQ ID NO: 12360 - DNA, 20 bp, Artificial Sequence
  Description of Artificial Sequence: Synthetic oligonucleotide
ttttcagcctcctgtgtagc

SEQ ID NO: 12361 - DNA, 20 bp, Artificial Sequence
  Description of Artificial Sequence: Synthetic oligonucleotide
tttcagcctcctgtgtagct

SEQ ID NO: 12362 - DNA, 20 bp, Artificial Sequence
  Description of Artificial Sequence: Synthetic oligonucleotide
ttcagcctcctgtgtagctg

SEQ ID NO: 12363 - DNA, 20 bp, Artificial Sequence
  Description of Artificial Sequence: Synthetic oligonucleotide
tcagcctcctgtgtagctgg

SEQ ID NO: 12364 - DNA, 20 bp, Artificial Sequence
  Description of Artificial Sequence: Synthetic oligonucleotide
cagcctcctgtgtagctggg

SEQ ID NO: 12365 - DNA, 20 bp, Artificial Sequence
  Description of Artificial Sequence: Synthetic oligonucleotide
agcctcctgtgtagctggga

SEQ ID NO: 12366 - DNA, 20 bp, Artificial Sequence
  Description of Artificial Sequence: Synthetic oligonucleotide
gcctcctgtgtagctgggac

SEQ ID NO: 12367 - DNA, 20 bp, Artificial Sequence
  Description of Artificial Sequence: Synthetic oligonucleotide
cctcctgtgtagctgggact

SEQ ID NO: 12368 - DNA, 20 bp, Artificial Sequence
  Description of Artificial Sequence: Synthetic oligonucleotide
ctcctgtgtagctgggacta

SEQ ID NO: 12369 - DNA, 20 bp, Artificial Sequence
  Description of Artificial Sequence: Synthetic oligonucleotide
tcctgtgtagctgggactac

SEQ ID NO: 12370 - DNA, 20 bp, Artificial Sequence
  Description of Artificial Sequence: Synthetic oligonucleotide
cctgtgtagctgggactaca

SEQ ID NO: 12371 - DNA, 20 bp, Artificial Sequence
  Description of Artificial Sequence: Synthetic oligonucleotide
ctgtgtagctgggactacag

SEQ ID NO: 12372 - DNA, 20 bp, Artificial Sequence
  Description of Artificial Sequence: Synthetic oligonucleotide
tgtgtagctgggactacagt

SEQ ID NO: 12373 - DNA, 20 bp, Artificial Sequence
  Description of Artificial Sequence: Synthetic oligonucleotide
gtgtagctgggactacagtc

SEQ ID NO: 12374 - DNA, 20 bp, Artificial Sequence
  Description of Artificial Sequence: Synthetic oligonucleotide
tgtagctgggactacagtca

SEQ ID NO: 12375 - DNA, 20 bp, Artificial Sequence
  Description of Artificial Sequence: Synthetic oligonucleotide
gtagctgggactacagtcat

SEQ ID NO: 12376 - DNA, 20 bp, Artificial Sequence
  Description of Artificial Sequence: Synthetic oligonucleotide
tagctgggactacagtcatg

SEQ ID NO: 12377 - DNA, 20 bp, Artificial Sequence
  Description of Artificial Sequence: Synthetic oligonucleotide
agctgggactacagtcatgc

SEQ ID NO: 12378 - DNA, 20 bp, Artificial Sequence
  Description of Artificial Sequence: Synthetic oligonucleotide
gctgggactacagtcatgca

SEQ ID NO: 12379 - DNA, 20 bp, Artificial Sequence
  Description of Artificial Sequence: Synthetic oligonucleotide
ctgggactacagtcatgcag

SEQ ID NO: 12380 - DNA, 20 bp, Artificial Sequence
  Description of Artificial Sequence: Synthetic oligonucleotide
tgggactacagtcatgcagc

SEQ ID NO: 12381 - DNA, 20 bp, Artificial Sequence
  Description of Artificial Sequence: Synthetic oligonucleotide
gggactacagtcatgcagct

SEQ ID NO: 12382 - DNA, 20 bp, Artificial Sequence
  Description of Artificial Sequence: Synthetic oligonucleotide
ggactacagtcatgcagctc

SEQ ID NO: 12383 - DNA, 20 bp, Artificial Sequence
  Description of Artificial Sequence: Synthetic oligonucleotide
gactacagtcatgcagctct

SEQ ID NO: 12384 - DNA, 20 bp, Artificial Sequence
  Description of Artificial Sequence: Synthetic oligonucleotide
actacagtcatgcagctcta

SEQ ID NO: 12385 - DNA, 20 bp, Artificial Sequence
  Description of Artificial Sequence: Synthetic oligonucleotide
ctacagtcatgcagctctat

SEQ ID NO: 12386 - DNA, 20 bp, Artificial Sequence
  Description of Artificial Sequence: Synthetic oligonucleotide
tacagtcatgcagctctatg

SEQ ID NO: 12387 - DNA, 20 bp, Artificial Sequence
  Description of Artificial Sequence: Synthetic oligonucleotide
acagtcatgcagctctatgc

SEQ ID NO: 12388 - DNA, 20 bp, Artificial Sequence
  Description of Artificial Sequence: Synthetic oligonucleotide
cagtcatgcagctctatgcc

SEQ ID NO: 12389 - DNA, 20 bp, Artificial Sequence
  Description of Artificial Sequence: Synthetic oligonucleotide
agtcatgcagctctatgcct

SEQ ID NO: 12390 - DNA, 20 bp, Artificial Sequence
  Description of Artificial Sequence: Synthetic oligonucleotide
gtcatgcagctctatgcctg

SEQ ID NO: 12391 - DNA, 20 bp, Artificial Sequence
  Description of Artificial Sequence: Synthetic oligonucleotide
tcatgcagctctatgcctgg

SEQ ID NO: 12392 - DNA, 20 bp, Artificial Sequence
  Description of Artificial Sequence: Synthetic oligonucleotide
catgcagctctatgcctggc

SEQ ID NO: 12393 - DNA, 20 bp, Artificial Sequence
  Description of Artificial Sequence: Synthetic oligonucleotide
atgcagctctatgcctggct

SEQ ID NO: 12394 - DNA, 20 bp, Artificial Sequence
  Description of Artificial Sequence: Synthetic oligonucleotide
tgcagctctatgcctggctt

SEQ ID NO: 12395 - DNA, 20 bp, Artificial Sequence
  Description of Artificial Sequence: Synthetic oligonucleotide
gcagctctatgcctggctta

SEQ ID NO: 12396 - DNA, 20 bp, Artificial Sequence
  Description of Artificial Sequence: Synthetic oligonucleotide
cagctctatgcctggcttat

SEQ ID NO: 12397 - DNA, 20 bp, Artificial Sequence
  Description of Artificial Sequence: Synthetic oligonucleotide
agctctatgcctggcttatt

SEQ ID NO: 12398 - DNA, 20 bp, Artificial Sequence
  Description of Artificial Sequence: Synthetic oligonucleotide
gctctatgcctggcttattt

SEQ ID NO: 12399 - DNA, 20 bp, Artificial Sequence
  Description of Artificial Sequence: Synthetic oligonucleotide
ctctatgcctggcttatttt

SEQ ID NO: 12400 - DNA, 20 bp, Artificial Sequence
  Description of Artificial Sequence: Synthetic oligonucleotide
tctatgcctggcttattttt

SEQ ID NO: 12401 - DNA, 20 bp, Artificial Sequence
  Description of Artificial Sequence: Synthetic oligonucleotide
ctatgcctggcttatttttt

SEQ ID NO: 12402 - DNA, 20 bp, Artificial Sequence
  Description of Artificial Sequence: Synthetic oligonucleotide
tatgcctggcttatttttta

SEQ ID NO: 12403 - DNA, 20 bp, Artificial Sequence
  Description of Artificial Sequence: Synthetic oligonucleotide
atgcctggcttattttttat

SEQ ID NO: 12404 - DNA, 20 bp, Artificial Sequence
  Description of Artificial Sequence: Synthetic oligonucleotide
tgcctggcttattttttatt

SEQ ID NO: 12405 - DNA, 20 bp, Artificial Sequence
  Description of Artificial Sequence: Synthetic oligonucleotide
gcctggcttattttttattt

SEQ ID NO: 12406 - DNA, 20 bp, Artificial Sequence
  Description of Artificial Sequence: Synthetic oligonucleotide
cctggcttattttttatttt

SEQ ID NO: 12407 - DNA, 20 bp, Artificial Sequence
  Description of Artificial Sequence: Synthetic oligonucleotide
ctggcttattttttattttt

SEQ ID NO: 12408 - DNA, 20 bp, Artificial Sequence
  Description of Artificial Sequence: Synthetic oligonucleotide
tggcttattttttatttttt

SEQ ID NO: 12409 - DNA, 20 bp, Artificial Sequence
  Description of Artificial Sequence: Synthetic oligonucleotide
ggcttattttttattttttc

SEQ ID NO: 12410 - DNA, 20 bp, Artificial Sequence
  Description of Artificial Sequence: Synthetic oligonucleotide
gcttattttttattttttca

SEQ ID NO: 12411 - DNA, 20 bp, Artificial Sequence
  Description of Artificial Sequence: Synthetic oligonucleotide
cttattttttattttttcag

SEQ ID NO: 12412 - DNA, 20 bp, Artificial Sequence
  Description of Artificial Sequence: Synthetic oligonucleotide
ttattttttattttttcaga

SEQ ID NO: 12413 - DNA, 20 bp, Artificial Sequence
  Description of Artificial Sequence: Synthetic oligonucleotide
tattttttattttttcagac

SEQ ID NO: 12414 - DNA, 20 bp, Artificial Sequence
  Description of Artificial Sequence: Synthetic oligonucleotide
attttttattttttcagaca

SEQ ID NO: 12415 - DNA, 20 bp, Artificial Sequence
  Description of Artificial Sequence: Synthetic oligonucleotide
ttttttattttttcagacag

SEQ ID NO: 12416 - DNA, 20 bp, Artificial Sequence
  Description of Artificial Sequence: Synthetic oligonucleotide
tttttattttttcagacaga

SEQ ID NO: 12417 - DNA, 20 bp, Artificial Sequence
  Description of Artificial Sequence: Synthetic oligonucleotide
ttttattttttcagacagag

SEQ ID NO: 12418 - DNA, 20 bp, Artificial Sequence
  Description of Artificial Sequence: Synthetic oligonucleotide
tttattttttcagacagagt

SEQ ID NO: 12419 - DNA, 20 bp, Artificial Sequence
  Description of Artificial Sequence: Synthetic oligonucleotide
ttattttttcagacagagtc

SEQ ID NO: 12420 - DNA, 20 bp, Artificial Sequence
  Description of Artificial Sequence: Synthetic oligonucleotide
tattttttcagacagagtct

SEQ ID NO: 12421 - DNA, 20 bp, Artificial Sequence
  Description of Artificial Sequence: Synthetic oligonucleotide
attttttcagacagagtctc

SEQ ID NO: 12422 - DNA, 20 bp, Artificial Sequence
  Description of Artificial Sequence: Synthetic oligonucleotide
ttttttcagacagagtctcg

SEQ ID NO: 12423 - DNA, 20 bp, Artificial Sequence
  Description of Artificial Sequence: Synthetic oligonucleotide
tttttcagacagagtctcgc

SEQ ID NO: 12424 - DNA, 20 bp, Artificial Sequence
  Description of Artificial Sequence: Synthetic oligonucleotide
ttttcagacagagtctcgct

SEQ ID NO: 12425 - DNA, 20 bp, Artificial Sequence
  Description of Artificial Sequence: Synthetic oligonucleotide
tttcagacagagtctcgctc

SEQ ID NO: 12426 - DNA, 20 bp, Artificial Sequence
  Description of Artificial Sequence: Synthetic oligonucleotide
ttcagacagagtctcgctct

SEQ ID NO: 12427 - DNA, 20 bp, Artificial Sequence
  Description of Artificial Sequence: Synthetic oligonucleotide
tcagacagagtctcgctctg

SEQ ID NO: 12428 - DNA, 20 bp, Artificial Sequence
  Description of Artificial Sequence: Synthetic oligonucleotide
cagacagagtctcgctctgt

SEQ ID NO: 12429 - DNA, 20 bp, Artificial Sequence
  Description of Artificial Sequence: Synthetic oligonucleotide
agacagagtctcgctctgtc

SEQ ID NO: 12430 - DNA, 20 bp, Artificial Sequence
  Description of Artificial Sequence: Synthetic oligonucleotide
gacagagtctcgctctgtca

SEQ ID NO: 12431 - DNA, 20 bp, Artificial Sequence
  Description of Artificial Sequence: Synthetic oligonucleotide
acagagtctcgctctgtcac

SEQ ID NO: 12432 - DNA, 20 bp, Artificial Sequence
  Description of Artificial Sequence: Synthetic oligonucleotide
cagagtctcgctctgtcacc

SEQ ID NO: 12433 - DNA, 20 bp, Artificial Sequence
  Description of Artificial Sequence: Synthetic oligonucleotide
agagtctcgctctgtcaccc

SEQ ID NO: 12434 - DNA, 20 bp, Artificial Sequence
  Description of Artificial Sequence: Synthetic oligonucleotide
gagtctcgctctgtcaccca

SEQ ID NO: 12435 - DNA, 20 bp, Artificial Sequence
  Description of Artificial Sequence: Synthetic oligonucleotide
agtctcgctctgtcacccag

SEQ ID NO: 12436 - DNA, 20 bp, Artificial Sequence
  Description of Artificial Sequence: Synthetic oligonucleotide
gtctcgctctgtcacccagg

SEQ ID NO: 12437 - DNA, 20 bp, Artificial Sequence
  Description of Artificial Sequence: Synthetic oligonucleotide
tctcgctctgtcacccaggt

SEQ ID NO: 12438 - DNA, 20 bp, Artificial Sequence
  Description of Artificial Sequence: Synthetic oligonucleotide
ctcgctctgtcacccaggtt

SEQ ID NO: 12439 - DNA, 20 bp, Artificial Sequence
  Description of Artificial Sequence: Synthetic oligonucleotide
tcgctctgtcacccaggttg

SEQ ID NO: 12440 - DNA, 20 bp, Artificial Sequence
  Description of Artificial Sequence: Synthetic oligonucleotide
cgctctgtcacccaggttgg

SEQ ID NO: 12441 - DNA, 20 bp, Artificial Sequence
  Description of Artificial Sequence: Synthetic oligonucleotide
gctctgtcacccaggttgga

SEQ ID NO: 12442 - DNA, 20 bp, Artificial Sequence
  Description of Artificial Sequence: Synthetic oligonucleotide
ctctgtcacccaggttggag

SEQ ID NO: 12443 - DNA, 20 bp, Artificial Sequence
  Description of Artificial Sequence: Synthetic oligonucleotide
tctgtcacccaggttggagt

SEQ ID NO: 12444 - DNA, 20 bp, Artificial Sequence
  Description of Artificial Sequence: Synthetic oligonucleotide
ctgtcacccaggttggagtg

SEQ ID NO: 12445 - DNA, 20 bp, Artificial Sequence
  Description of Artificial Sequence: Synthetic oligonucleotide
tgtcacccaggttggagtgc

SEQ ID NO: 12446 - DNA, 20 bp, Artificial Sequence
  Description of Artificial Sequence: Synthetic oligonucleotide
gtcacccaggttggagtgca

SEQ ID NO: 12447 - DNA, 20 bp, Artificial Sequence
  Description of Artificial Sequence: Synthetic oligonucleotide
tcacccaggttggagtgcag

SEQ ID NO: 12448 - DNA, 20 bp, Artificial Sequence
  Description of Artificial Sequence: Synthetic oligonucleotide
cacccaggttggagtgcagt

SEQ ID NO: 12449 - DNA, 20 bp, Artificial Sequence
  Description of Artificial Sequence: Synthetic oligonucleotide
acccaggttggagtgcagtg

SEQ ID NO: 12450 - DNA, 20 bp, Artificial Sequence
  Description of Artificial Sequence: Synthetic oligonucleotide
cccaggttggagtgcagtgg

SEQ ID NO: 12451 - DNA, 20 bp, Artificial Sequence
  Description of Artificial Sequence: Synthetic oligonucleotide
ccaggttggagtgcagtggc

SEQ ID NO: 12452 - DNA, 20 bp, Artificial Sequence
  Description of Artificial Sequence: Synthetic oligonucleotide
caggttggagtgcagtggcg

SEQ ID NO: 12453 - DNA, 20 bp, Artificial Sequence
  Description of Artificial Sequence: Synthetic oligonucleotide
aggttggagtgcagtggcgc

SEQ ID NO: 12454 - DNA, 20 bp, Artificial Sequence
  Description of Artificial Sequence: Synthetic oligonucleotide
ggttggagtgcagtggcgca

SEQ ID NO: 12455 - DNA, 20 bp, Artificial Sequence
  Description of Artificial Sequence: Synthetic oligonucleotide
gttggagtgcagtggcgcaa

SEQ ID NO: 12456 - DNA, 20 bp, Artificial Sequence
  Description of Artificial Sequence: Synthetic oligonucleotide
ttggagtgcagtggcgcaat

SEQ ID NO: 12457 - DNA, 20 bp, Artificial Sequence
  Description of Artificial Sequence: Synthetic oligonucleotide
tggagtgcagtggcgcaatc

SEQ ID NO: 12458 - DNA, 20 bp, Artificial Sequence
  Description of Artificial Sequence: Synthetic oligonucleotide
ggagtgcagtggcgcaatct

SEQ ID NO: 12459 - DNA, 20 bp, Artificial Sequence
  Description of Artificial Sequence: Synthetic oligonucleotide
gagtgcagtggcgcaatctt

SEQ ID NO: 12460 - DNA, 20 bp, Artificial Sequence
  Description of Artificial Sequence: Synthetic oligonucleotide
agtgcagtggcgcaatcttg

SEQ ID NO: 12461 - DNA, 20 bp, Artificial Sequence
  Description of Artificial Sequence: Synthetic oligonucleotide
gtgcagtggcgcaatcttgg

SEQ ID NO: 12462 - DNA, 20 bp, Artificial Sequence
  Description of Artificial Sequence: Synthetic oligonucleotide
tgcagtggcgcaatcttggc

SEQ ID NO: 12463 - DNA, 20 bp, Artificial Sequence
  Description of Artificial Sequence: Synthetic oligonucleotide
gcagtggcgcaatcttggct

SEQ ID NO: 12464 - DNA, 20 bp, Artificial Sequence
  Description of Artificial Sequence: Synthetic oligonucleotide
cagtggcgcaatcttggctc

SEQ ID NO: 12465 - DNA, 20 bp, Artificial Sequence
  Description of Artificial Sequence: Synthetic oligonucleotide
agtggcgcaatcttggctca

SEQ ID NO: 12466 - DNA, 20 bp, Artificial Sequence
  Description of Artificial Sequence: Synthetic oligonucleotide
gtggcgcaatcttggctcac

SEQ ID NO: 12467 - DNA, 20 bp, Artificial Sequence
  Description of Artificial Sequence: Synthetic oligonucleotide
tggcgcaatcttggctcact

SEQ ID NO: 12468 - DNA, 20 bp, Artificial Sequence
  Description of Artificial Sequence: Synthetic oligonucleotide
ggcgcaatcttggctcactg

SEQ ID NO: 12469 - DNA, 20 bp, Artificial Sequence
  Description of Artificial Sequence: Synthetic oligonucleotide
gcgcaatcttggctcactgc

SEQ ID NO: 12470 - DNA, 20 bp, Artificial Sequence
  Description of Artificial Sequence: Synthetic oligonucleotide
cgcaatcttggctcactgca

SEQ ID NO: 12471 - DNA, 20 bp, Artificial Sequence
  Description of Artificial Sequence: Synthetic oligonucleotide
gcaatcttggctcactgcaa

SEQ ID NO: 12472 - DNA, 20 bp, Artificial Sequence
  Description of Artificial Sequence: Synthetic oligonucleotide
caatcttggctcactgcaac

SEQ ID NO: 12473 - DNA, 20 bp, Artificial Sequence
  Description of Artificial Sequence: Synthetic oligonucleotide
aatcttggctcactgcaacc

SEQ ID NO: 12474 - DNA, 20 bp, Artificial Sequence
  Description of Artificial Sequence: Synthetic oligonucleotide
atcttggctcactgcaacct

SEQ ID NO: 12475 - DNA, 20 bp, Artificial Sequence
  Description of Artificial Sequence: Synthetic oligonucleotide
tcttggctcactgcaacctc

SEQ ID NO: 12476 - DNA, 20 bp, Artificial Sequence
  Description of Artificial Sequence: Synthetic oligonucleotide
cttggctcactgcaacctct

SEQ ID NO: 12477 - DNA, 20 bp, Artificial Sequence
  Description of Artificial Sequence: Synthetic oligonucleotide
ttggctcactgcaacctctg

SEQ ID NO: 12478 - DNA, 20 bp, Artificial Sequence
  Description of Artificial Sequence: Synthetic oligonucleotide
tggctcactgcaacctctgc

SEQ ID NO: 12479 - DNA, 20 bp, Artificial Sequence
  Description of Artificial Sequence: Synthetic oligonucleotide
ggctcactgcaacctctgcc

SEQ ID NO: 12480 - DNA, 20 bp, Artificial Sequence
  Description of Artificial Sequence: Synthetic oligonucleotide
gctcactgcaacctctgcct

SEQ ID NO: 12481 - DNA, 20 bp, Artificial Sequence
  Description of Artificial Sequence: Synthetic oligonucleotide
ctcactgcaacctctgcctc

SEQ ID NO: 12482 - DNA, 20 bp, Artificial Sequence
  Description of Artificial Sequence: Synthetic oligonucleotide
tcactgcaacctctgcctcc

SEQ ID NO: 12483 - DNA, 20 bp, Artificial Sequence
  Description of Artificial Sequence: Synthetic oligonucleotide
cactgcaacctctgcctccc

SEQ ID NO: 12484 - DNA, 20 bp, Artificial Sequence
  Description of Artificial Sequence: Synthetic oligonucleotide
actgcaacctctgcctccca

SEQ ID NO: 12485 - DNA, 20 bp, Artificial Sequence
  Description of Artificial Sequence: Synthetic oligonucleotide
ctgcaacctctgcctcccag

SEQ ID NO: 12486 - DNA, 20 bp, Artificial Sequence
  Description of Artificial Sequence: Synthetic oligonucleotide
tgcaacctctgcctcccaga

SEQ ID NO: 12487 - DNA, 20 bp, Artificial Sequence
  Description of Artificial Sequence: Synthetic oligonucleotide
gcaacctctgcctcccagac

SEQ ID NO: 12488 - DNA, 20 bp, Artificial Sequence
  Description of Artificial Sequence: Synthetic oligonucleotide
caacctctgcctcccagact

SEQ ID NO: 12489 - DNA, 20 bp, Artificial Sequence
  Description of Artificial Sequence: Synthetic oligonucleotide
aacctctgcctcccagactc

SEQ ID NO: 12490 - DNA, 20 bp, Artificial Sequence
  Description of Artificial Sequence: Synthetic oligonucleotide
acctctgcctcccagactca

SEQ ID NO: 12491 - DNA, 20 bp, Artificial Sequence
  Description of Artificial Sequence: Synthetic oligonucleotide
cctctgcctcccagactcaa

SEQ ID NO: 12492 - DNA, 20 bp, Artificial Sequence
  Description of Artificial Sequence: Synthetic oligonucleotide
ctctgcctcccagactcaag

SEQ ID NO: 12493 - DNA, 20 bp, Artificial Sequence
  Description of Artificial Sequence: Synthetic oligonucleotide
tctgcctcccagactcaagt

SEQ ID NO: 12494 - DNA, 20 bp, Artificial Sequence
  Description of Artificial Sequence: Synthetic oligonucleotide
ctgcctcccagactcaagtg

SEQ ID NO: 12495 - DNA, 20 bp, Artificial Sequence
  Description of Artificial Sequence: Synthetic oligonucleotide
tgcctcccagactcaagtga

SEQ ID NO: 12496 - DNA, 20 bp, Artificial Sequence
  Description of Artificial Sequence: Synthetic oligonucleotide
gcctcccagactcaagtgat

SEQ ID NO: 12497 - DNA, 20 bp, Artificial Sequence
  Description of Artificial Sequence: Synthetic oligonucleotide
cctcccagactcaagtgatt

SEQ ID NO: 12498 - DNA, 20 bp, Artificial Sequence
  Description of Artificial Sequence: Synthetic oligonucleotide
ctcccagactcaagtgattc

SEQ ID NO: 12499 - DNA, 20 bp, Artificial Sequence
  Description of Artificial Sequence: Synthetic oligonucleotide
tcccagactcaagtgattct

SEQ ID NO: 12500 - DNA, 20 bp, Artificial Sequence
  Description of Artificial Sequence: Synthetic oligonucleotide
cccagactcaagtgattctt

SEQ ID NO: 12501 - DNA, 20 bp, Artificial Sequence
  Description of Artificial Sequence: Synthetic oligonucleotide
ccagactcaagtgattcttg

SEQ ID NO: 12502 - DNA, 20 bp, Artificial Sequence
  Description of Artificial Sequence: Synthetic oligonucleotide
cagactcaagtgattcttgt

SEQ ID NO: 12503 - DNA, 20 bp, Artificial Sequence
  Description of Artificial Sequence: Synthetic oligonucleotide
agactcaagtgattcttgtg

SEQ ID NO: 12504 - DNA, 20 bp, Artificial Sequence
  Description of Artificial Sequence: Synthetic oligonucleotide
gactcaagtgattcttgtgt

SEQ ID NO: 12505 - DNA, 20 bp, Artificial Sequence
  Description of Artificial Sequence: Synthetic oligonucleotide
actcaagtgattcttgtgtc

SEQ ID NO: 12506 - DNA, 20 bp, Artificial Sequence
  Description of Artificial Sequence: Synthetic oligonucleotide
ctcaagtgattcttgtgtct

SEQ ID NO: 12507 - DNA, 20 bp, Artificial Sequence
  Description of Artificial Sequence: Synthetic oligonucleotide
tcaagtgattcttgtgtctc

SEQ ID NO: 12508 - DNA, 20 bp, Artificial Sequence
  Description of Artificial Sequence: Synthetic oligonucleotide
caagtgattcttgtgtctca

SEQ ID NO: 12509 - DNA, 20 bp, Artificial Sequence
  Description of Artificial Sequence: Synthetic oligonucleotide
aagtgattcttgtgtctcag

SEQ ID NO: 12510 - DNA, 20 bp, Artificial Sequence
  Description of Artificial Sequence: Synthetic oligonucleotide
agtgattcttgtgtctcagc

SEQ ID NO: 12511 - DNA, 20 bp, Artificial Sequence
  Description of Artificial Sequence: Synthetic oligonucleotide
gtgattcttgtgtctcagcc

SEQ ID NO: 12512 - DNA, 20 bp, Artificial Sequence
  Description of Artificial Sequence: Synthetic oligonucleotide
tgattcttgtgtctcagcct

SEQ ID NO: 12513 - DNA, 20 bp, Artificial Sequence
  Description of Artificial Sequence: Synthetic oligonucleotide
gattcttgtgtctcagcctc

SEQ ID NO: 12514 - DNA, 20 bp, Artificial Sequence
  Description of Artificial Sequence: Synthetic oligonucleotide
attcttgtgtctcagcctcc

SEQ ID NO: 12515 - DNA, 20 bp, Artificial Sequence
  Description of Artificial Sequence: Synthetic oligonucleotide
ttcttgtgtctcagcctccc

SEQ ID NO: 12516 - DNA, 20 bp, Artificial Sequence
  Description of Artificial Sequence: Synthetic oligonucleotide
tcttgtgtctcagcctccca

SEQ ID NO: 12517 - DNA, 20 bp, Artificial Sequence
  Description of Artificial Sequence: Synthetic oligonucleotide
cttgtgtctcagcctcccaa

SEQ ID NO: 12518 - DNA, 20 bp, Artificial Sequence
  Description of Artificial Sequence: Synthetic oligonucleotide
ttgtgtctcagcctcccaag

SEQ ID NO: 12519 - DNA, 20 bp, Artificial Sequence
  Description of Artificial Sequence: Synthetic oligonucleotide
tgtgtctcagcctcccaagt

SEQ ID NO: 12520 - DNA, 20 bp, Artificial Sequence
  Description of Artificial Sequence: Synthetic oligonucleotide
gtgtctcagcctcccaagta

SEQ ID NO: 12521 - DNA, 20 bp, Artificial Sequence
  Description of Artificial Sequence: Synthetic oligonucleotide
tgtctcagcctcccaagtag

SEQ ID NO: 12522 - DNA, 20 bp, Artificial Sequence
  Description of Artificial Sequence: Synthetic oligonucleotide
gtctcagcctcccaagtagc

SEQ ID NO: 12523 - DNA, 20 bp, Artificial Sequence
  Description of Artificial Sequence: Synthetic oligonucleotide
tctcagcctcccaagtagct

SEQ ID NO: 12524 - DNA, 20 bp, Artificial Sequence
  Description of Artificial Sequence: Synthetic oligonucleotide
ctcagcctcccaagtagctg

SEQ ID NO: 12525 - DNA, 20 bp, Artificial Sequence
  Description of Artificial Sequence: Synthetic oligonucleotide
tcagcctcccaagtagctgc

SEQ ID NO: 12526 - DNA, 20 bp, Artificial Sequence
  Description of Artificial Sequence: Synthetic oligonucleotide
cagcctcccaagtagctgcc

SEQ ID NO: 12527 - DNA, 20 bp, Artificial Sequence
  Description of Artificial Sequence: Synthetic oligonucleotide
agcctcccaagtagctgcca

SEQ ID NO: 12528 - DNA, 20 bp, Artificial Sequence
  Description of Artificial Sequence: Synthetic oligonucleotide
gcctcccaagtagctgccac

SEQ ID NO: 12529 - DNA, 20 bp, Artificial Sequence
  Description of Artificial Sequence: Synthetic oligonucleotide
cctcccaagtagctgccacc

SEQ ID NO: 12530 - DNA, 20 bp, Artificial Sequence
  Description of Artificial Sequence: Synthetic oligonucleotide
ctcccaagtagctgccacca

SEQ ID NO: 12531 - DNA, 20 bp, Artificial Sequence
  Description of Artificial Sequence: Synthetic oligonucleotide
tcccaagtagctgccaccac

SEQ ID NO: 12532 - DNA, 20 bp, Artificial Sequence
  Description of Artificial Sequence: Synthetic oligonucleotide
cccaagtagctgccaccaca

SEQ ID NO: 12533 - DNA, 20 bp, Artificial Sequence
  Description of Artificial Sequence: Synthetic oligonucleotide
ccaagtagctgccaccacac

SEQ ID NO: 12534 - DNA, 20 bp, Artificial Sequence
  Description of Artificial Sequence: Synthetic oligonucleotide
caagtagctgccaccacacc

SEQ ID NO: 12535 - DNA, 20 bp, Artificial Sequence
  Description of Artificial Sequence: Synthetic oligonucleotide
aagtagctgccaccacacct

SEQ ID NO: 12536 - DNA, 20 bp, Artificial Sequence
  Description of Artificial Sequence: Synthetic oligonucleotide
agtagctgccaccacacctg

SEQ ID NO: 12537 - DNA, 20 bp, Artificial Sequence
  Description of Artificial Sequence: Synthetic oligonucleotide
gtagctgccaccacacctgg

SEQ ID NO: 12538 - DNA, 20 bp, Artificial Sequence
  Description of Artificial Sequence: Synthetic oligonucleotide
tagctgccaccacacctggc

SEQ ID NO: 12539 - DNA, 20 bp, Artificial Sequence
  Description of Artificial Sequence: Synthetic oligonucleotide
agctgccaccacacctggct

SEQ ID NO: 12540 - DNA, 20 bp, Artificial Sequence
  Description of Artificial Sequence: Synthetic oligonucleotide
gctgccaccacacctggcta

SEQ ID NO: 12541 - DNA, 20 bp, Artificial Sequence
  Description of Artificial Sequence: Synthetic oligonucleotide
ctgccaccacacctggctaa

SEQ ID NO: 12542 - DNA, 20 bp, Artificial Sequence
  Description of Artificial Sequence: Synthetic oligonucleotide
tgccaccacacctggctaat

SEQ ID NO: 12543 - DNA, 20 bp, Artificial Sequence
  Description of Artificial Sequence: Synthetic oligonucleotide
gccaccacacctggctaatt

SEQ ID NO: 12544 - DNA, 20 bp, Artificial Sequence
  Description of Artificial Sequence: Synthetic oligonucleotide
ccaccacacctggctaattt

SEQ ID NO: 12545 - DNA, 20 bp, Artificial Sequence
  Description of Artificial Sequence: Synthetic oligonucleotide
caccacacctggctaatttt

SEQ ID NO: 12546 - DNA, 20 bp, Artificial Sequence
  Description of Artificial Sequence: Synthetic oligonucleotide
accacacctggctaattttt

SEQ ID NO: 12547 - DNA, 20 bp, Artificial Sequence
  Description of Artificial Sequence: Synthetic oligonucleotide
ccacacctggctaatttttg

SEQ ID NO: 12548 - DNA, 20 bp, Artificial Sequence
  Description of Artificial Sequence: Synthetic oligonucleotide
cacacctggctaatttttgt

SEQ ID NO: 12549 - DNA, 20 bp, Artificial Sequence
  Description of Artificial Sequence: Synthetic oligonucleotide
acacctggctaatttttgta

SEQ ID NO: 12550 - DNA, 20 bp, Artificial Sequence
  Description of Artificial Sequence: Synthetic oligonucleotide
cacctggctaatttttgtat

SEQ ID NO: 12551 - DNA, 20 bp, Artificial Sequence
  Description of Artificial Sequence: Synthetic oligonucleotide
acctggctaatttttgtatt

SEQ ID NO: 12552 - DNA, 20 bp, Artificial Sequence
  Description of Artificial Sequence: Synthetic oligonucleotide
cctggctaatttttgtattt

SEQ ID NO: 12553 - DNA, 20 bp, Artificial Sequence
  Description of Artificial Sequence: Synthetic oligonucleotide
ctggctaatttttgtatttg

SEQ ID NO: 12554 - DNA, 20 bp, Artificial Sequence
  Description of Artificial Sequence: Synthetic oligonucleotide
tggctaatttttgtatttgt

SEQ ID NO: 12555 - DNA, 20 bp, Artificial Sequence
  Description of Artificial Sequence: Synthetic oligonucleotide
ggctaatttttgtatttgta

SEQ ID NO: 12556 - DNA, 20 bp, Artificial Sequence
  Description of Artificial Sequence: Synthetic oligonucleotide
gctaatttttgtatttgtat

SEQ ID NO: 12557 - DNA, 20 bp, Artificial Sequence
  Description of Artificial Sequence: Synthetic oligonucleotide
ctaatttttgtatttgtatt

SEQ ID NO: 12558 - DNA, 20 bp, Artificial Sequence
  Description of Artificial Sequence: Synthetic oligonucleotide
taatttttgtatttgtattt

SEQ ID NO: 12559 - DNA, 20 bp, Artificial Sequence
  Description of Artificial Sequence: Synthetic oligonucleotide
aatttttgtatttgtatttt

SEQ ID NO: 12560 - DNA, 20 bp, Artificial Sequence
  Description of Artificial Sequence: Synthetic oligonucleotide
atttttgtatttgtatttta

SEQ ID NO: 12561 - DNA, 20 bp, Artificial Sequence
  Description of Artificial Sequence: Synthetic oligonucleotide
tttttgtatttgtattttat

SEQ ID NO: 12562 - DNA, 20 bp, Artificial Sequence
  Description of Artificial Sequence: Synthetic oligonucleotide
ttttgtatttgtattttatt

SEQ ID NO: 12563 - DNA, 20 bp, Artificial Sequence
  Description of Artificial Sequence: Synthetic oligonucleotide
tttgtatttgtattttattt

SEQ ID NO: 12564 - DNA, 20 bp, Artificial Sequence
  Description of Artificial Sequence: Synthetic oligonucleotide
ttgtatttgtattttatttt

SEQ ID NO: 12565 - DNA, 20 bp, Artificial Sequence
  Description of Artificial Sequence: Synthetic oligonucleotide
tgtatttgtattttatttta

SEQ ID NO: 12566 - DNA, 20 bp, Artificial Sequence
  Description of Artificial Sequence: Synthetic oligonucleotide
gtatttgtattttattttat

SEQ ID NO: 12567 - DNA, 20 bp, Artificial Sequence
  Description of Artificial Sequence: Synthetic oligonucleotide
tatttgtattttattttatt

SEQ ID NO: 12568 - DNA, 20 bp, Artificial Sequence
  Description of Artificial Sequence: Synthetic oligonucleotide
atttgtattttattttattt

SEQ ID NO: 12569 - DNA, 20 bp, Artificial Sequence
  Description of Artificial Sequence: Synthetic oligonucleotide
tttgtattttattttattta

SEQ ID NO: 12570 - DNA, 20 bp, Artificial Sequence
  Description of Artificial Sequence: Synthetic oligonucleotide
ttgtattttattttatttat

SEQ ID NO: 12571 - DNA, 20 bp, Artificial Sequence
  Description of Artificial Sequence: Synthetic oligonucleotide
tgtattttattttatttatt

SEQ ID NO: 12572 - DNA, 20 bp, Artificial Sequence
  Description of Artificial Sequence: Synthetic oligonucleotide
gtattttattttatttatta

SEQ ID NO: 12573 - DNA, 20 bp, Artificial Sequence
  Description of Artificial Sequence: Synthetic oligonucleotide
tattttattttatttattat

SEQ ID NO: 12574 - DNA, 20 bp, Artificial Sequence
  Description of Artificial Sequence: Synthetic oligonucleotide
attttattttatttattatt

SEQ ID NO: 12575 - DNA, 20 bp, Artificial Sequence
  Description of Artificial Sequence: Synthetic oligonucleotide
ttttattttatttattatta

SEQ ID NO: 12576 - DNA, 20 bp, Artificial Sequence
  Description of Artificial Sequence: Synthetic oligonucleotide
tttattttatttattattat

SEQ ID NO: 12577 - DNA, 20 bp, Artificial Sequence
  Description of Artificial Sequence: Synthetic oligonucleotide
ttattttatttattattatt

SEQ ID NO: 12578 - DNA, 20 bp, Artificial Sequence
  Description of Artificial Sequence: Synthetic oligonucleotide
tattttatttattattatta

SEQ ID NO: 12579 - DNA, 20 bp, Artificial Sequence
  Description of Artificial Sequence: Synthetic oligonucleotide
attttatttattattattat

SEQ ID NO: 12580 - DNA, 20 bp, Artificial Sequence
  Description of Artificial Sequence: Synthetic oligonucleotide
ttttatttattattattatt

SEQ ID NO: 12581 - DNA, 20 bp, Artificial Sequence
  Description of Artificial Sequence: Synthetic oligonucleotide
tttatttattattattatta

SEQ ID NO: 12582 - DNA, 20 bp, Artificial Sequence
  Description of Artificial Sequence: Synthetic oligonucleotide
ttatttattattattattat

SEQ ID NO: 12583 - DNA, 20 bp, Artificial Sequence
  Description of Artificial Sequence: Synthetic oligonucleotide
tatttattattattattatt

SEQ ID NO: 12584 - DNA, 20 bp, Artificial Sequence
  Description of Artificial Sequence: Synthetic oligonucleotide
atttattattattattattt

SEQ ID NO: 12585 - DNA, 20 bp, Artificial Sequence
  Description of Artificial Sequence: Synthetic oligonucleotide
tttattattattattatttt

SEQ ID NO: 12586 - DNA, 20 bp, Artificial Sequence
  Description of Artificial Sequence: Synthetic oligonucleotide
ttattattattattattttg

SEQ ID NO: 12587 - DNA, 20 bp, Artificial Sequence
  Description of Artificial Sequence: Synthetic oligonucleotide
tattattattattattttga

SEQ ID NO: 12588 - DNA, 20 bp, Artificial Sequence
  Description of Artificial Sequence: Synthetic oligonucleotide
attattattattattttgag

SEQ ID NO: 12589 - DNA, 20 bp, Artificial Sequence
  Description of Artificial Sequence: Synthetic oligonucleotide
ttattattattattttgaga

SEQ ID NO: 12590 - DNA, 20 bp, Artificial Sequence
  Description of Artificial Sequence: Synthetic oligonucleotide
tattattattattttgagat

SEQ ID NO: 12591 - DNA, 20 bp, Artificial Sequence
  Description of Artificial Sequence: Synthetic oligonucleotide
attattattattttgagatg

SEQ ID NO: 12592 - DNA, 20 bp, Artificial Sequence
  Description of Artificial Sequence: Synthetic oligonucleotide
ttattattattttgagatgg

SEQ ID NO: 12593 - DNA, 20 bp, Artificial Sequence
  Description of Artificial Sequence: Synthetic oligonucleotide
tattattattttgagatgga

SEQ ID NO: 12594 - DNA, 20 bp, Artificial Sequence
  Description of Artificial Sequence: Synthetic oligonucleotide
attattattttgagatggag

SEQ ID NO: 12595 - DNA, 20 bp, Artificial Sequence
  Description of Artificial Sequence: Synthetic oligonucleotide
ttattattttgagatggagt

SEQ ID NO: 12596 - DNA, 20 bp, Artificial Sequence
  Description of Artificial Sequence: Synthetic oligonucleotide
tattattttgagatggagtc

SEQ ID NO: 12597 - DNA, 20 bp, Artificial Sequence
  Description of Artificial Sequence: Synthetic oligonucleotide
attattttgagatggagtcg

SEQ ID NO: 12598 - DNA, 20 bp, Artificial Sequence
  Description of Artificial Sequence: Synthetic oligonucleotide
ttattttgagatggagtcga

SEQ ID NO: 12599 - DNA, 20 bp, Artificial Sequence
  Description of Artificial Sequence: Synthetic oligonucleotide
tattttgagatggagtcgag

SEQ ID NO: 12600 - DNA, 20 bp, Artificial Sequence
  Description of Artificial Sequence: Synthetic oligonucleotide
attttgagatggagtcgagc

SEQ ID NO: 12601 - DNA, 20 bp, Artificial Sequence
  Description of Artificial Sequence: Synthetic oligonucleotide
ttttgagatggagtcgagct

SEQ ID NO: 12602 - DNA, 20 bp, Artificial Sequence
  Description of Artificial Sequence: Synthetic oligonucleotide
tttgagatggagtcgagctc

SEQ ID NO: 12603 - DNA, 20 bp, Artificial Sequence
  Description of Artificial Sequence: Synthetic oligonucleotide
ttgagatggagtcgagctct

SEQ ID NO: 12604 - DNA, 20 bp, Artificial Sequence
  Description of Artificial Sequence: Synthetic oligonucleotide
tgagatggagtcgagctctg

SEQ ID NO: 12605 - DNA, 20 bp, Artificial Sequence
  Description of Artificial Sequence: Synthetic oligonucleotide
gagatggagtcgagctctgt

SEQ ID NO: 12606 - DNA, 20 bp, Artificial Sequence
  Description of Artificial Sequence: Synthetic oligonucleotide
agatggagtcgagctctgtc

SEQ ID NO: 12607 - DNA, 20 bp, Artificial Sequence
  Description of Artificial Sequence: Synthetic oligonucleotide
gatggagtcgagctctgtcg

SEQ ID NO: 12608 - DNA, 20 bp, Artificial Sequence
  Description of Artificial Sequence: Synthetic oligonucleotide
atggagtcgagctctgtcgc

SEQ ID NO: 12609 - DNA, 20 bp, Artificial Sequence
  Description of Artificial Sequence: Synthetic oligonucleotide
tggagtcgagctctgtcgcc

SEQ ID NO: 12610 - DNA, 20 bp, Artificial Sequence
  Description of Artificial Sequence: Synthetic oligonucleotide
ggagtcgagctctgtcgccc

SEQ ID NO: 12611 - DNA, 20 bp, Artificial Sequence
  Description of Artificial Sequence: Synthetic oligonucleotide
gagtcgagctctgtcgccca

SEQ ID NO: 12612 - DNA, 20 bp, Artificial Sequence
  Description of Artificial Sequence: Synthetic oligonucleotide
agtcgagctctgtcgcccag

SEQ ID NO: 12613 - DNA, 20 bp, Artificial Sequence
  Description of Artificial Sequence: Synthetic oligonucleotide
gtcgagctctgtcgcccagg

SEQ ID NO: 12614 - DNA, 20 bp, Artificial Sequence
  Description of Artificial Sequence: Synthetic oligonucleotide
tcgagctctgtcgcccaggc

SEQ ID NO: 12615 - DNA, 20 bp, Artificial Sequence
  Description of Artificial Sequence: Synthetic oligonucleotide
cgagctctgtcgcccaggct

SEQ ID NO: 12616 - DNA, 20 bp, Artificial Sequence
  Description of Artificial Sequence: Synthetic oligonucleotide
gagctctgtcgcccaggctg

SEQ ID NO: 12617 - DNA, 20 bp, Artificial Sequence
  Description of Artificial Sequence: Synthetic oligonucleotide
agctctgtcgcccaggctgg

SEQ ID NO: 12618 - DNA, 20 bp, Artificial Sequence
  Description of Artificial Sequence: Synthetic oligonucleotide
gctctgtcgcccaggctgga

SEQ ID NO: 12619 - DNA, 20 bp, Artificial Sequence
  Description of Artificial Sequence: Synthetic oligonucleotide
ctctgtcgcccaggctggag

SEQ ID NO: 12620 - DNA, 20 bp, Artificial Sequence
  Description of Artificial Sequence: Synthetic oligonucleotide
tctgtcgcccaggctggagt

SEQ ID NO: 12621 - DNA, 20 bp, Artificial Sequence
  Description of Artificial Sequence: Synthetic oligonucleotide
ctgtcgcccaggctggagtg

SEQ ID NO: 12622 - DNA, 20 bp, Artificial Sequence
  Description of Artificial Sequence: Synthetic oligonucleotide
tgtcgcccaggctggagtgc

SEQ ID NO: 12623 - DNA, 20 bp, Artificial Sequence
  Description of Artificial Sequence: Synthetic oligonucleotide
gtcgcccaggctggagtgca

SEQ ID NO: 12624 - DNA, 20 bp, Artificial Sequence
  Description of Artificial Sequence: Synthetic oligonucleotide
tcgcccaggctggagtgcaa

SEQ ID NO: 12625 - DNA, 20 bp, Artificial Sequence
  Description of Artificial Sequence: Synthetic oligonucleotide
cgcccaggctggagtgcaat

SEQ ID NO: 12626 - DNA, 20 bp, Artificial Sequence
  Description of Artificial Sequence: Synthetic oligonucleotide
gcccaggctggagtgcaatg

SEQ ID NO: 12627 - DNA, 20 bp, Artificial Sequence
  Description of Artificial Sequence: Synthetic oligonucleotide
cccaggctggagtgcaatgg

SEQ ID NO: 12628 - DNA, 20 bp, Artificial Sequence
  Description of Artificial Sequence: Synthetic oligonucleotide
ccaggctggagtgcaatggc

SEQ ID NO: 12629 - DNA, 20 bp, Artificial Sequence
  Description of Artificial Sequence: Synthetic oligonucleotide
caggctggagtgcaatggca

SEQ ID NO: 12630 - DNA, 20 bp, Artificial Sequence
  Description of Artificial Sequence: Synthetic oligonucleotide
aggctggagtgcaatggcat

SEQ ID NO: 12631 - DNA, 20 bp, Artificial Sequence
  Description of Artificial Sequence: Synthetic oligonucleotide
ggctggagtgcaatggcatg

SEQ ID NO: 12632 - DNA, 20 bp, Artificial Sequence
  Description of Artificial Sequence: Synthetic oligonucleotide
gctggagtgcaatggcatga

SEQ ID NO: 12633 - DNA, 20 bp, Artificial Sequence
  Description of Artificial Sequence: Synthetic oligonucleotide
ctggagtgcaatggcatgat

SEQ ID NO: 12634 - DNA, 20 bp, Artificial Sequence
  Description of Artificial Sequence: Synthetic oligonucleotide
tggagtgcaatggcatgatc

SEQ ID NO: 12635 - DNA, 20 bp, Artificial Sequence
  Description of Artificial Sequence: Synthetic oligonucleotide
ggagtgcaatggcatgatcc

SEQ ID NO: 12636 - DNA, 20 bp, Artificial Sequence
  Description of Artificial Sequence: Synthetic oligonucleotide
gagtgcaatggcatgatccc

SEQ ID NO: 12637 - DNA, 20 bp, Artificial Sequence
  Description of Artificial Sequence: Synthetic oligonucleotide
agtgcaatggcatgatcccg

SEQ ID NO: 12638 - DNA, 20 bp, Artificial Sequence
  Description of Artificial Sequence: Synthetic oligonucleotide
gtgcaatggcatgatcccgg

SEQ ID NO: 12639 - DNA, 20 bp, Artificial Sequence
  Description of Artificial Sequence: Synthetic oligonucleotide
tgcaatggcatgatcccggc

SEQ ID NO: 12640 - DNA, 20 bp, Artificial Sequence
  Description of Artificial Sequence: Synthetic oligonucleotide
gcaatggcatgatcccggct

SEQ ID NO: 12641 - DNA, 20 bp, Artificial Sequence
  Description of Artificial Sequence: Synthetic oligonucleotide
caatggcatgatcccggctc

SEQ ID NO: 12642 - DNA, 20 bp, Artificial Sequence
  Description of Artificial Sequence: Synthetic oligonucleotide
aatggcatgatcccggctca

SEQ ID NO: 12643 - DNA, 20 bp, Artificial Sequence
  Description of Artificial Sequence: Synthetic oligonucleotide
atggcatgatcccggctcac

SEQ ID NO: 12644 - DNA, 20 bp, Artificial Sequence
  Description of Artificial Sequence: Synthetic oligonucleotide
tggcatgatcccggctcact

SEQ ID NO: 12645 - DNA, 20 bp, Artificial Sequence
  Description of Artificial Sequence: Synthetic oligonucleotide
ggcatgatcccggctcactg

SEQ ID NO: 12646 - DNA, 20 bp, Artificial Sequence
  Description of Artificial Sequence: Synthetic oligonucleotide
gcatgatcccggctcactgc

SEQ ID NO: 12647 - DNA, 20 bp, Artificial Sequence
  Description of Artificial Sequence: Synthetic oligonucleotide
catgatcccggctcactgca

SEQ ID NO: 12648 - DNA, 20 bp, Artificial Sequence
  Description of Artificial Sequence: Synthetic oligonucleotide
atgatcccggctcactgcaa

SEQ ID NO: 12649 - DNA, 20 bp, Artificial Sequence
  Description of Artificial Sequence: Synthetic oligonucleotide
tgatcccggctcactgcaac

SEQ ID NO: 12650 - DNA, 20 bp, Artificial Sequence
  Description of Artificial Sequence: Synthetic oligonucleotide
gatcccggctcactgcaacc

SEQ ID NO: 12651 - DNA, 20 bp, Artificial Sequence
  Description of Artificial Sequence: Synthetic oligonucleotide
atcccggctcactgcaacct

SEQ ID NO: 12652 - DNA, 20 bp, Artificial Sequence
  Description of Artificial Sequence: Synthetic oligonucleotide
tcccggctcactgcaacctc

SEQ ID NO: 12653 - DNA, 20 bp, Artificial Sequence
  Description of Artificial Sequence: Synthetic oligonucleotide
cccggctcactgcaacctcc

SEQ ID NO: 12654 - DNA, 20 bp, Artificial Sequence
  Description of Artificial Sequence: Synthetic oligonucleotide
ccggctcactgcaacctccg

SEQ ID NO: 12655 - DNA, 20 bp, Artificial Sequence
  Description of Artificial Sequence: Synthetic oligonucleotide
cggctcactgcaacctccgc

SEQ ID NO: 12656 - DNA, 20 bp, Artificial Sequence
  Description of Artificial Sequence: Synthetic oligonucleotide
ggctcactgcaacctccgcc

SEQ ID NO: 12657 - DNA, 20 bp, Artificial Sequence
  Description of Artificial Sequence: Synthetic oligonucleotide
gctcactgcaacctccgcct

SEQ ID NO: 12658 - DNA, 20 bp, Artificial Sequence
  Description of Artificial Sequence: Synthetic oligonucleotide
ctcactgcaacctccgcctc

SEQ ID NO: 12659 - DNA, 20 bp, Artificial Sequence
  Description of Artificial Sequence: Synthetic oligonucleotide
tcactgcaacctccgcctcc

SEQ ID NO: 12660 - DNA, 20 bp, Artificial Sequence
  Description of Artificial Sequence: Synthetic oligonucleotide
cactgcaacctccgcctccc

SEQ ID NO: 12661 - DNA, 20 bp, Artificial Sequence
  Description of Artificial Sequence: Synthetic oligonucleotide
actgcaacctccgcctcccg

SEQ ID NO: 12662 - DNA, 20 bp, Artificial Sequence
  Description of Artificial Sequence: Synthetic oligonucleotide
ctgcaacctccgcctcccgg

SEQ ID NO: 12663 - DNA, 20 bp, Artificial Sequence
  Description of Artificial Sequence: Synthetic oligonucleotide
tgcaacctccgcctcccggg

SEQ ID NO: 12664 - DNA, 20 bp, Artificial Sequence
  Description of Artificial Sequence: Synthetic oligonucleotide
gcaacctccgcctcccgggt

SEQ ID NO: 12665 - DNA, 20 bp, Artificial Sequence
  Description of Artificial Sequence: Synthetic oligonucleotide
caacctccgcctcccgggtt

SEQ ID NO: 12666 - DNA, 20 bp, Artificial Sequence
  Description of Artificial Sequence: Synthetic oligonucleotide
aacctccgcctcccgggttc

SEQ ID NO: 12667 - DNA, 20 bp, Artificial Sequence
  Description of Artificial Sequence: Synthetic oligonucleotide
acctccgcctcccgggttca

SEQ ID NO: 12668 - DNA, 20 bp, Artificial Sequence
  Description of Artificial Sequence: Synthetic oligonucleotide
cctccgcctcccgggttcaa

SEQ ID NO: 12669 - DNA, 20 bp, Artificial Sequence
  Description of Artificial Sequence: Synthetic oligonucleotide
ctccgcctcccgggttcaag

SEQ ID NO: 12670 - DNA, 20 bp, Artificial Sequence
  Description of Artificial Sequence: Synthetic oligonucleotide
tccgcctcccgggttcaaga

SEQ ID NO: 12671 - DNA, 20 bp, Artificial Sequence
  Description of Artificial Sequence: Synthetic oligonucleotide
ccgcctcccgggttcaagag

SEQ ID NO: 12672 - DNA, 20 bp, Artificial Sequence
  Description of Artificial Sequence: Synthetic oligonucleotide
cgcctcccgggttcaagagg

SEQ ID NO: 12673 - DNA, 20 bp, Artificial Sequence
  Description of Artificial Sequence: Synthetic oligonucleotide
gcctcccgggttcaagaggt

SEQ ID NO: 12674 - DNA, 20 bp, Artificial Sequence
  Description of Artificial Sequence: Synthetic oligonucleotide
cctcccgggttcaagaggtt

SEQ ID NO: 12675 - DNA, 20 bp, Artificial Sequence
  Description of Artificial Sequence: Synthetic oligonucleotide
ctcccgggttcaagaggttc

SEQ ID NO: 12676 - DNA, 20 bp, Artificial Sequence
  Description of Artificial Sequence: Synthetic oligonucleotide
tcccgggttcaagaggttct

SEQ ID NO: 12677 - DNA, 20 bp, Artificial Sequence
  Description of Artificial Sequence: Synthetic oligonucleotide
cccgggttcaagaggttctc

SEQ ID NO: 12678 - DNA, 20 bp, Artificial Sequence
  Description of Artificial Sequence: Synthetic oligonucleotide
ccgggttcaagaggttctcc

SEQ ID NO: 12679 - DNA, 20 bp, Artificial Sequence
  Description of Artificial Sequence: Synthetic oligonucleotide
cgggttcaagaggttctcct

SEQ ID NO: 12680 - DNA, 20 bp, Artificial Sequence
  Description of Artificial Sequence: Synthetic oligonucleotide
gggttcaagaggttctcctg

SEQ ID NO: 12681 - DNA, 20 bp, Artificial Sequence
  Description of Artificial Sequence: Synthetic oligonucleotide
ggttcaagaggttctcctgc

SEQ ID NO: 12682 - DNA, 20 bp, Artificial Sequence
  Description of Artificial Sequence: Synthetic oligonucleotide
gttcaagaggttctcctgcc

SEQ ID NO: 12683 - DNA, 20 bp, Artificial Sequence
  Description of Artificial Sequence: Synthetic oligonucleotide
ttcaagaggttctcctgcct

SEQ ID NO: 12684 - DNA, 20 bp, Artificial Sequence
  Description of Artificial Sequence: Synthetic oligonucleotide
tcaagaggttctcctgcctc

SEQ ID NO: 12685 - DNA, 20 bp, Artificial Sequence
  Description of Artificial Sequence: Synthetic oligonucleotide
caagaggttctcctgcctca

SEQ ID NO: 12686 - DNA, 20 bp, Artificial Sequence
  Description of Artificial Sequence: Synthetic oligonucleotide
aagaggttctcctgcctcag

SEQ ID NO: 12687 - DNA, 20 bp, Artificial Sequence
  Description of Artificial Sequence: Synthetic oligonucleotide
agaggttctcctgcctcagc

SEQ ID NO: 12688 - DNA, 20 bp, Artificial Sequence
  Description of Artificial Sequence: Synthetic oligonucleotide
gaggttctcctgcctcagcc

SEQ ID NO: 12689 - DNA, 20 bp, Artificial Sequence
  Description of Artificial Sequence: Synthetic oligonucleotide
aggttctcctgcctcagcct

SEQ ID NO: 12690 - DNA, 20 bp, Artificial Sequence
  Description of Artificial Sequence: Synthetic oligonucleotide
ggttctcctgcctcagcctc

SEQ ID NO: 12691 - DNA, 20 bp, Artificial Sequence
  Description of Artificial Sequence: Synthetic oligonucleotide
gttctcctgcctcagcctcc

SEQ ID NO: 12692 - DNA, 20 bp, Artificial Sequence
  Description of Artificial Sequence: Synthetic oligonucleotide
ttctcctgcctcagcctccc

SEQ ID NO: 12693 - DNA, 20 bp, Artificial Sequence
  Description of Artificial Sequence: Synthetic oligonucleotide
tctcctgcctcagcctcccc

SEQ ID NO: 12694 - DNA, 20 bp, Artificial Sequence
  Description of Artificial Sequence: Synthetic oligonucleotide
ctcctgcctcagcctcccca

SEQ ID NO: 12695 - DNA, 20 bp, Artificial Sequence
  Description of Artificial Sequence: Synthetic oligonucleotide
tcctgcctcagcctccccag

SEQ ID NO: 12696 - DNA, 20 bp, Artificial Sequence
  Description of Artificial Sequence: Synthetic oligonucleotide
cctgcctcagcctccccagt

SEQ ID NO: 12697 - DNA, 20 bp, Artificial Sequence
  Description of Artificial Sequence: Synthetic oligonucleotide
ctgcctcagcctccccagta

SEQ ID NO: 12698 - DNA, 20 bp, Artificial Sequence
  Description of Artificial Sequence: Synthetic oligonucleotide
tgcctcagcctccccagtag

SEQ ID NO: 12699 - DNA, 20 bp, Artificial Sequence
  Description of Artificial Sequence: Synthetic oligonucleotide
gcctcagcctccccagtagc

SEQ ID NO: 12700 - DNA, 20 bp, Artificial Sequence
  Description of Artificial Sequence: Synthetic oligonucleotide
cctcagcctccccagtagct

SEQ ID NO: 12701 - DNA, 20 bp, Artificial Sequence
  Description of Artificial Sequence: Synthetic oligonucleotide
ctcagcctccccagtagctg

SEQ ID NO: 12702 - DNA, 20 bp, Artificial Sequence
  Description of Artificial Sequence: Synthetic oligonucleotide
tcagcctccccagtagctgg

SEQ ID NO: 12703 - DNA, 20 bp, Artificial Sequence
  Description of Artificial Sequence: Synthetic oligonucleotide
cagcctccccagtagctggg

SEQ ID NO: 12704 - DNA, 20 bp, Artificial Sequence
  Description of Artificial Sequence: Synthetic oligonucleotide
agcctccccagtagctggga

SEQ ID NO: 12705 - DNA, 20 bp, Artificial Sequence
  Description of Artificial Sequence: Synthetic oligonucleotide
gcctccccagtagctgggat

SEQ ID NO: 12706 - DNA, 20 bp, Artificial Sequence
  Description of Artificial Sequence: Synthetic oligonucleotide
cctccccagtagctgggatt

SEQ ID NO: 12707 - DNA, 20 bp, Artificial Sequence
  Description of Artificial Sequence: Synthetic oligonucleotide
ctccccagtagctgggatta

SEQ ID NO: 12708 - DNA, 20 bp, Artificial Sequence
  Description of Artificial Sequence: Synthetic oligonucleotide
tccccagtagctgggattac

SEQ ID NO: 12709 - DNA, 20 bp, Artificial Sequence
  Description of Artificial Sequence: Synthetic oligonucleotide
ccccagtagctgggattaca

SEQ ID NO: 12710 - DNA, 20 bp, Artificial Sequence
  Description of Artificial Sequence: Synthetic oligonucleotide
cccagtagctgggattacag

SEQ ID NO: 12711 - DNA, 20 bp, Artificial Sequence
  Description of Artificial Sequence: Synthetic oligonucleotide
ccagtagctgggattacagg

SEQ ID NO: 12712 - DNA, 20 bp, Artificial Sequence
  Description of Artificial Sequence: Synthetic oligonucleotide
cagtagctgggattacaggc

SEQ ID NO: 12713 - DNA, 20 bp, Artificial Sequence
  Description of Artificial Sequence: Synthetic oligonucleotide
agtagctgggattacaggcg

SEQ ID NO: 12714 - DNA, 20 bp, Artificial Sequence
  Description of Artificial Sequence: Synthetic oligonucleotide
gtagctgggattacaggcgc

SEQ ID NO: 12715 - DNA, 20 bp, Artificial Sequence
  Description of Artificial Sequence: Synthetic oligonucleotide
tagctgggattacaggcgcc

SEQ ID NO: 12716 - DNA, 20 bp, Artificial Sequence
  Description of Artificial Sequence: Synthetic oligonucleotide
agctgggattacaggcgccc

SEQ ID NO: 12717 - DNA, 20 bp, Artificial Sequence
  Description of Artificial Sequence: Synthetic oligonucleotide
gctgggattacaggcgccca

SEQ ID NO: 12718 - DNA, 20 bp, Artificial Sequence
  Description of Artificial Sequence: Synthetic oligonucleotide
ctgggattacaggcgcccac

SEQ ID NO: 12719 - DNA, 20 bp, Artificial Sequence
  Description of Artificial Sequence: Synthetic oligonucleotide
tgggattacaggcgcccacc

SEQ ID NO: 12720 - DNA, 20 bp, Artificial Sequence
  Description of Artificial Sequence: Synthetic oligonucleotide
gggattacaggcgcccacca

SEQ ID NO: 12721 - DNA, 20 bp, Artificial Sequence
  Description of Artificial Sequence: Synthetic oligonucleotide
ggattacaggcgcccaccac

SEQ ID NO: 12722 - DNA, 20 bp, Artificial Sequence
  Description of Artificial Sequence: Synthetic oligonucleotide
gattacaggcgcccaccacc

SEQ ID NO: 12723 - DNA, 20 bp, Artificial Sequence
  Description of Artificial Sequence: Synthetic oligonucleotide
attacaggcgcccaccacca

SEQ ID NO: 12724 - DNA, 20 bp, Artificial Sequence
  Description of Artificial Sequence: Synthetic oligonucleotide
ttacaggcgcccaccaccac

SEQ ID NO: 12725 - DNA, 20 bp, Artificial Sequence
  Description of Artificial Sequence: Synthetic oligonucleotide
tacaggcgcccaccaccaca

SEQ ID NO: 12726 - DNA, 20 bp, Artificial Sequence
  Description of Artificial Sequence: Synthetic oligonucleotide
acaggcgcccaccaccacac

SEQ ID NO: 12727 - DNA, 20 bp, Artificial Sequence
  Description of Artificial Sequence: Synthetic oligonucleotide
caggcgcccaccaccacacc

SEQ ID NO: 12728 - DNA, 20 bp, Artificial Sequence
  Description of Artificial Sequence: Synthetic oligonucleotide
aggcgcccaccaccacaccc

SEQ ID NO: 12729 - DNA, 20 bp, Artificial Sequence
  Description of Artificial Sequence: Synthetic oligonucleotide
ggcgcccaccaccacaccca

SEQ ID NO: 12730 - DNA, 20 bp, Artificial Sequence
  Description of Artificial Sequence: Synthetic oligonucleotide
gcgcccaccaccacacccag

SEQ ID NO: 12731 - DNA, 20 bp, Artificial Sequence
  Description of Artificial Sequence: Synthetic oligonucleotide
cgcccaccaccacacccagc

SEQ ID NO: 12732 - DNA, 20 bp, Artificial Sequence
  Description of Artificial Sequence: Synthetic oligonucleotide
gcccaccaccacacccagct

SEQ ID NO: 12733 - DNA, 20 bp, Artificial Sequence
  Description of Artificial Sequence: Synthetic oligonucleotide
cccaccaccacacccagcta

SEQ ID NO: 12734 - DNA, 20 bp, Artificial Sequence
  Description of Artificial Sequence: Synthetic oligonucleotide
ccaccaccacacccagctaa

SEQ ID NO: 12735 - DNA, 20 bp, Artificial Sequence
  Description of Artificial Sequence: Synthetic oligonucleotide
caccaccacacccagctaat

SEQ ID NO: 12736 - DNA, 20 bp, Artificial Sequence
  Description of Artificial Sequence: Synthetic oligonucleotide
accaccacacccagctaatt

SEQ ID NO: 12737 - DNA, 20 bp, Artificial Sequence
  Description of Artificial Sequence: Synthetic oligonucleotide
ccaccacacccagctaattt

SEQ ID NO: 12738 - DNA, 20 bp, Artificial Sequence
  Description of Artificial Sequence: Synthetic oligonucleotide
caccacacccagctaatttt

SEQ ID NO: 12739 - DNA, 20 bp, Artificial Sequence
  Description of Artificial Sequence: Synthetic oligonucleotide
accacacccagctaattttt

SEQ ID NO: 12740 - DNA, 20 bp, Artificial Sequence
  Description of Artificial Sequence: Synthetic oligonucleotide
ccacacccagctaatttttg

SEQ ID NO: 12741 - DNA, 20 bp, Artificial Sequence
  Description of Artificial Sequence: Synthetic oligonucleotide
cacacccagctaatttttgt

SEQ ID NO: 12742 - DNA, 20 bp, Artificial Sequence
  Description of Artificial Sequence: Synthetic oligonucleotide
acacccagctaatttttgta

SEQ ID NO: 12743 - DNA, 20 bp, Artificial Sequence
  Description of Artificial Sequence: Synthetic oligonucleotide
cacccagctaatttttgtat

SEQ ID NO: 12744 - DNA, 20 bp, Artificial Sequence
  Description of Artificial Sequence: Synthetic oligonucleotide
acccagctaatttttgtatt

SEQ ID NO: 12745 - DNA, 20 bp, Artificial Sequence
  Description of Artificial Sequence: Synthetic oligonucleotide
cccagctaatttttgtattt

SEQ ID NO: 12746 - DNA, 20 bp, Artificial Sequence
  Description of Artificial Sequence: Synthetic oligonucleotide
ccagctaatttttgtatttt

SEQ ID NO: 12747 - DNA, 20 bp, Artificial Sequence
  Description of Artificial Sequence: Synthetic oligonucleotide
cagctaatttttgtattttt

SEQ ID NO: 12748 - DNA, 20 bp, Artificial Sequence
  Description of Artificial Sequence: Synthetic oligonucleotide
agctaatttttgtattttta

SEQ ID NO: 12749 - DNA, 20 bp, Artificial Sequence
  Description of Artificial Sequence: Synthetic oligonucleotide
gctaatttttgtatttttag

SEQ ID NO: 12750 - DNA, 20 bp, Artificial Sequence
  Description of Artificial Sequence: Synthetic oligonucleotide
ctaatttttgtatttttagt

SEQ ID NO: 12751 - DNA, 20 bp, Artificial Sequence
  Description of Artificial Sequence: Synthetic oligonucleotide
taatttttgtatttttagta

SEQ ID NO: 12752 - DNA, 20 bp, Artificial Sequence
  Description of Artificial Sequence: Synthetic oligonucleotide
aatttttgtatttttagtag

SEQ ID NO: 12753 - DNA, 20 bp, Artificial Sequence
  Description of Artificial Sequence: Synthetic oligonucleotide
atttttgtatttttagtaga

SEQ ID NO: 12754 - DNA, 20 bp, Artificial Sequence
  Description of Artificial Sequence: Synthetic oligonucleotide
tttttgtatttttagtagag

SEQ ID NO: 12755 - DNA, 20 bp, Artificial Sequence
  Description of Artificial Sequence: Synthetic oligonucleotide
ttttgtatttttagtagaga

SEQ ID NO: 12756 - DNA, 20 bp, Artificial Sequence
  Description of Artificial Sequence: Synthetic oligonucleotide
tttgtatttttagtagagac

SEQ ID NO: 12757 - DNA, 20 bp, Artificial Sequence
  Description of Artificial Sequence: Synthetic oligonucleotide
ttgtatttttagtagagacg

SEQ ID NO: 12758 - DNA, 20 bp, Artificial Sequence
  Description of Artificial Sequence: Synthetic oligonucleotide
tgtatttttagtagagacgg

SEQ ID NO: 12759 - DNA, 20 bp, Artificial Sequence
  Description of Artificial Sequence: Synthetic oligonucleotide
gtatttttagtagagacggg

SEQ ID NO: 12760 - DNA, 20 bp, Artificial Sequence
  Description of Artificial Sequence: Synthetic oligonucleotide
tatttttagtagagacgggg

SEQ ID NO: 12761 - DNA, 20 bp, Artificial Sequence
  Description of Artificial Sequence: Synthetic oligonucleotide
atttttagtagagacggggt

SEQ ID NO: 12762 - DNA, 20 bp, Artificial Sequence
  Description of Artificial Sequence: Synthetic oligonucleotide
tttttagtagagacggggtt

SEQ ID NO: 12763 - DNA, 20 bp, Artificial Sequence
  Description of Artificial Sequence: Synthetic oligonucleotide
ttttagtagagacggggttt

SEQ ID NO: 12764 - DNA, 20 bp, Artificial Sequence
  Description of Artificial Sequence: Synthetic oligonucleotide
tttagtagagacggggtttc

SEQ ID NO: 12765 - DNA, 20 bp, Artificial Sequence
  Description of Artificial Sequence: Synthetic oligonucleotide
ttagtagagacggggtttca

SEQ ID NO: 12766 - DNA, 20 bp, Artificial Sequence
  Description of Artificial Sequence: Synthetic oligonucleotide
tagtagagacggggtttcac

SEQ ID NO: 12767 - DNA, 20 bp, Artificial Sequence
  Description of Artificial Sequence: Synthetic oligonucleotide
agtagagacggggtttcact

SEQ ID NO: 12768 - DNA, 20 bp, Artificial Sequence
  Description of Artificial Sequence: Synthetic oligonucleotide
gtagagacggggtttcactg

SEQ ID NO: 12769 - DNA, 20 bp, Artificial Sequence
  Description of Artificial Sequence: Synthetic oligonucleotide
tagagacggggtttcactgt

SEQ ID NO: 12770 - DNA, 20 bp, Artificial Sequence
  Description of Artificial Sequence: Synthetic oligonucleotide
agagacggggtttcactgtg

SEQ ID NO: 12771 - DNA, 20 bp, Artificial Sequence
  Description of Artificial Sequence: Synthetic oligonucleotide
gagacggggtttcactgtgt

SEQ ID NO: 12772 - DNA, 20 bp, Artificial Sequence
  Description of Artificial Sequence: Synthetic oligonucleotide
agacggggtttcactgtgtt

SEQ ID NO: 12773 - DNA, 20 bp, Artificial Sequence
  Description of Artificial Sequence: Synthetic oligonucleotide
gacggggtttcactgtgttg

SEQ ID NO: 12774 - DNA, 20 bp, Artificial Sequence
  Description of Artificial Sequence: Synthetic oligonucleotide
acggggtttcactgtgttgg

SEQ ID NO: 12775 - DNA, 20 bp, Artificial Sequence
  Description of Artificial Sequence: Synthetic oligonucleotide
cggggtttcactgtgttggt

SEQ ID NO: 12776 - DNA, 20 bp, Artificial Sequence
  Description of Artificial Sequence: Synthetic oligonucleotide
ggggtttcactgtgttggtc

SEQ ID NO: 12777 - DNA, 20 bp, Artificial Sequence
  Description of Artificial Sequence: Synthetic oligonucleotide
gggtttcactgtgttggtca

SEQ ID NO: 12778 - DNA, 20 bp, Artificial Sequence
  Description of Artificial Sequence: Synthetic oligonucleotide
ggtttcactgtgttggtcag

SEQ ID NO: 12779 - DNA, 20 bp, Artificial Sequence
  Description of Artificial Sequence: Synthetic oligonucleotide
gtttcactgtgttggtcagg

SEQ ID NO: 12780 - DNA, 20 bp, Artificial Sequence
  Description of Artificial Sequence: Synthetic oligonucleotide
tttcactgtgttggtcaggc

SEQ ID NO: 12781 - DNA, 20 bp, Artificial Sequence
  Description of Artificial Sequence: Synthetic oligonucleotide
ttcactgtgttggtcaggct

SEQ ID NO: 12782 - DNA, 20 bp, Artificial Sequence
  Description of Artificial Sequence: Synthetic oligonucleotide
tcactgtgttggtcaggctg

SEQ ID NO: 12783 - DNA, 20 bp, Artificial Sequence
  Description of Artificial Sequence: Synthetic oligonucleotide
cactgtgttggtcaggctgg

SEQ ID NO: 12784 - DNA, 20 bp, Artificial Sequence
  Description of Artificial Sequence: Synthetic oligonucleotide
actgtgttggtcaggctggt

SEQ ID NO: 12785 - DNA, 20 bp, Artificial Sequence
  Description of Artificial Sequence: Synthetic oligonucleotide
ctgtgttggtcaggctggtc

SEQ ID NO: 12786 - DNA, 20 bp, Artificial Sequence
  Description of Artificial Sequence: Synthetic oligonucleotide
tgtgttggtcaggctggtct

SEQ ID NO: 12787 - DNA, 20 bp, Artificial Sequence
  Description of Artificial Sequence: Synthetic oligonucleotide
gtgttggtcaggctggtctt

SEQ ID NO: 12788 - DNA, 20 bp, Artificial Sequence
  Description of Artificial Sequence: Synthetic oligonucleotide
tgttggtcaggctggtcttg

SEQ ID NO: 12789 - DNA, 20 bp, Artificial Sequence
  Description of Artificial Sequence: Synthetic oligonucleotide
gttggtcaggctggtcttga

SEQ ID NO: 12790 - DNA, 20 bp, Artificial Sequence
  Description of Artificial Sequence: Synthetic oligonucleotide
ttggtcaggctggtcttgaa

SEQ ID NO: 12791 - DNA, 20 bp, Artificial Sequence
  Description of Artificial Sequence: Synthetic oligonucleotide
tggtcaggctggtcttgaac

SEQ ID NO: 12792 - DNA, 20 bp, Artificial Sequence
  Description of Artificial Sequence: Synthetic oligonucleotide
ggtcaggctggtcttgaact

SEQ ID NO: 12793 - DNA, 20 bp, Artificial Sequence
  Description of Artificial Sequence: Synthetic oligonucleotide
gtcaggctggtcttgaactc

SEQ ID NO: 12794 - DNA, 20 bp, Artificial Sequence
  Description of Artificial Sequence: Synthetic oligonucleotide
tcaggctggtcttgaactcc

SEQ ID NO: 12795 - DNA, 20 bp, Artificial Sequence
  Description of Artificial Sequence: Synthetic oligonucleotide
caggctggtcttgaactcct

SEQ ID NO: 12796 - DNA, 20 bp, Artificial Sequence
  Description of Artificial Sequence: Synthetic oligonucleotide
aggctggtcttgaactcctg

SEQ ID NO: 12797 - DNA, 20 bp, Artificial Sequence
  Description of Artificial Sequence: Synthetic oligonucleotide
ggctggtcttgaactcctga

SEQ ID NO: 12798 - DNA, 20 bp, Artificial Sequence
  Description of Artificial Sequence: Synthetic oligonucleotide
gctggtcttgaactcctgac

SEQ ID NO: 12799 - DNA, 20 bp, Artificial Sequence
  Description of Artificial Sequence: Synthetic oligonucleotide
ctggtcttgaactcctgacc

SEQ ID NO: 12800 - DNA, 20 bp, Artificial Sequence
  Description of Artificial Sequence: Synthetic oligonucleotide
tggtcttgaactcctgacct

SEQ ID NO: 12801 - DNA, 20 bp, Artificial Sequence
  Description of Artificial Sequence: Synthetic oligonucleotide
ggtcttgaactcctgacctc

SEQ ID NO: 12802 - DNA, 20 bp, Artificial Sequence
  Description of Artificial Sequence: Synthetic oligonucleotide
gtcttgaactcctgacctca

SEQ ID NO: 12803 - DNA, 20 bp, Artificial Sequence
  Description of Artificial Sequence: Synthetic oligonucleotide
tcttgaactcctgacctcag

SEQ ID NO: 12804 - DNA, 20 bp, Artificial Sequence
  Description of Artificial Sequence: Synthetic oligonucleotide
cttgaactcctgacctcagg

SEQ ID NO: 12805 - DNA, 20 bp, Artificial Sequence
  Description of Artificial Sequence: Synthetic oligonucleotide
ttgaactcctgacctcaggt

SEQ ID NO: 12806 - DNA, 20 bp, Artificial Sequence
  Description of Artificial Sequence: Synthetic oligonucleotide
tgaactcctgacctcaggtg

SEQ ID NO: 12807 - DNA, 20 bp, Artificial Sequence
  Description of Artificial Sequence: Synthetic oligonucleotide
gaactcctgacctcaggtga

SEQ ID NO: 12808 - DNA, 20 bp, Artificial Sequence
  Description of Artificial Sequence: Synthetic oligonucleotide
aactcctgacctcaggtgat

SEQ ID NO: 12809 - DNA, 20 bp, Artificial Sequence
  Description of Artificial Sequence: Synthetic oligonucleotide
actcctgacctcaggtgatc

SEQ ID NO: 12810 - DNA, 20 bp, Artificial Sequence
  Description of Artificial Sequence: Synthetic oligonucleotide
ctcctgacctcaggtgatcc

SEQ ID NO: 12811 - DNA, 20 bp, Artificial Sequence
  Description of Artificial Sequence: Synthetic oligonucleotide
tcctgacctcaggtgatcca

SEQ ID NO: 12812 - DNA, 20 bp, Artificial Sequence
  Description of Artificial Sequence: Synthetic oligonucleotide
cctgacctcaggtgatccac

SEQ ID NO: 12813 - DNA, 20 bp, Artificial Sequence
  Description of Artificial Sequence: Synthetic oligonucleotide
ctgacctcaggtgatccact

SEQ ID NO: 12814 - DNA, 20 bp, Artificial Sequence
  Description of Artificial Sequence: Synthetic oligonucleotide
tgacctcaggtgatccactg

SEQ ID NO: 12815 - DNA, 20 bp, Artificial Sequence
  Description of Artificial Sequence: Synthetic oligonucleotide
gacctcaggtgatccactgg

SEQ ID NO: 12816 - DNA, 20 bp, Artificial Sequence
  Description of Artificial Sequence: Synthetic oligonucleotide
acctcaggtgatccactggc

SEQ ID NO: 12817 - DNA, 20 bp, Artificial Sequence
  Description of Artificial Sequence: Synthetic oligonucleotide
cctcaggtgatccactggcc

SEQ ID NO: 12818 - DNA, 20 bp, Artificial Sequence
  Description of Artificial Sequence: Synthetic oligonucleotide
ctcaggtgatccactggcct

SEQ ID NO: 12819 - DNA, 20 bp, Artificial Sequence
  Description of Artificial Sequence: Synthetic oligonucleotide
tcaggtgatccactggcctc

SEQ ID NO: 12820 - DNA, 20 bp, Artificial Sequence
  Description of Artificial Sequence: Synthetic oligonucleotide
caggtgatccactggcctcg

SEQ ID NO: 12821 - DNA, 20 bp, Artificial Sequence
  Description of Artificial Sequence: Synthetic oligonucleotide
aggtgatccactggcctcgc

SEQ ID NO: 12822 - DNA, 20 bp, Artificial Sequence
  Description of Artificial Sequence: Synthetic oligonucleotide
ggtgatccactggcctcgcc

SEQ ID NO: 12823 - DNA, 20 bp, Artificial Sequence
  Description of Artificial Sequence: Synthetic oligonucleotide
gtgatccactggcctcgccc

SEQ ID NO: 12824 - DNA, 20 bp, Artificial Sequence
  Description of Artificial Sequence: Synthetic oligonucleotide
tgatccactggcctcgccct

SEQ ID NO: 12825 - DNA, 20 bp, Artificial Sequence
  Description of Artificial Sequence: Synthetic oligonucleotide
gatccactggcctcgccctc

SEQ ID NO: 12826 - DNA, 20 bp, Artificial Sequence
  Description of Artificial Sequence: Synthetic oligonucleotide
atccactggcctcgccctcc

SEQ ID NO: 12827 - DNA, 20 bp, Artificial Sequence
  Description of Artificial Sequence: Synthetic oligonucleotide
tccactggcctcgccctccc

SEQ ID NO: 12828 - DNA, 20 bp, Artificial Sequence
  Description of Artificial Sequence: Synthetic oligonucleotide
ccactggcctcgccctccca

SEQ ID NO: 12829 - DNA, 20 bp, Artificial Sequence
  Description of Artificial Sequence: Synthetic oligonucleotide
cactggcctcgccctcccaa

SEQ ID NO: 12830 - DNA, 20 bp, Artificial Sequence
  Description of Artificial Sequence: Synthetic oligonucleotide
actggcctcgccctcccaaa

SEQ ID NO: 12831 - DNA, 20 bp, Artificial Sequence
  Description of Artificial Sequence: Synthetic oligonucleotide
ctggcctcgccctcccaaag

SEQ ID NO: 12832 - DNA, 20 bp, Artificial Sequence
  Description of Artificial Sequence: Synthetic oligonucleotide
tggcctcgccctcccaaagt

SEQ ID NO: 12833 - DNA, 20 bp, Artificial Sequence
  Description of Artificial Sequence: Synthetic oligonucleotide
ggcctcgccctcccaaagtg

SEQ ID NO: 12834 - DNA, 20 bp, Artificial Sequence
  Description of Artificial Sequence: Synthetic oligonucleotide
gcctcgccctcccaaagtgc

SEQ ID NO: 12835 - DNA, 20 bp, Artificial Sequence
  Description of Artificial Sequence: Synthetic oligonucleotide
cctcgccctcccaaagtgct

SEQ ID NO: 12836 - DNA, 20 bp, Artificial Sequence
  Description of Artificial Sequence: Synthetic oligonucleotide
ctcgccctcccaaagtgctg

SEQ ID NO: 12837 - DNA, 20 bp, Artificial Sequence
  Description of Artificial Sequence: Synthetic oligonucleotide
tcgccctcccaaagtgctgg

SEQ ID NO: 12838 - DNA, 20 bp, Artificial Sequence
  Description of Artificial Sequence: Synthetic oligonucleotide
cgccctcccaaagtgctggg

SEQ ID NO: 12839 - DNA, 20 bp, Artificial Sequence
  Description of Artificial Sequence: Synthetic oligonucleotide
gccctcccaaagtgctggga

SEQ ID NO: 12840 - DNA, 20 bp, Artificial Sequence
  Description of Artificial Sequence: Synthetic oligonucleotide
ccctcccaaagtgctgggac

SEQ ID NO: 12841 - DNA, 20 bp, Artificial Sequence
  Description of Artificial Sequence: Synthetic oligonucleotide
cctcccaaagtgctgggact

SEQ ID NO: 12842 - DNA, 20 bp, Artificial Sequence
  Description of Artificial Sequence: Synthetic oligonucleotide
ctcccaaagtgctgggacta

SEQ ID NO: 12843 - DNA, 20 bp, Artificial Sequence
  Description of Artificial Sequence: Synthetic oligonucleotide
tcccaaagtgctgggactac

SEQ ID NO: 12844 - DNA, 20 bp, Artificial Sequence
  Description of Artificial Sequence: Synthetic oligonucleotide
cccaaagtgctgggactaca

SEQ ID NO: 12845 - DNA, 20 bp, Artificial Sequence
  Description of Artificial Sequence: Synthetic oligonucleotide
ccaaagtgctgggactacaa

SEQ ID NO: 12846 - DNA, 20 bp, Artificial Sequence
  Description of Artificial Sequence: Synthetic oligonucleotide
caaagtgctgggactacaag

SEQ ID NO: 12847 - DNA, 20 bp, Artificial Sequence
  Description of Artificial Sequence: Synthetic oligonucleotide
aaagtgctgggactacaagc

SEQ ID NO: 12848 - DNA, 20 bp, Artificial Sequence
  Description of Artificial Sequence: Synthetic oligonucleotide
aagtgctgggactacaagcg

SEQ ID NO: 12849 - DNA, 20 bp, Artificial Sequence
  Description of Artificial Sequence: Synthetic oligonucleotide
agtgctgggactacaagcgt

SEQ ID NO: 12850 - DNA, 20 bp, Artificial Sequence
  Description of Artificial Sequence: Synthetic oligonucleotide
gtgctgggactacaagcgtg

SEQ ID NO: 12851 - DNA, 20 bp, Artificial Sequence
  Description of Artificial Sequence: Synthetic oligonucleotide
tgctgggactacaagcgtga

SEQ ID NO: 12852 - DNA, 20 bp, Artificial Sequence
  Description of Artificial Sequence: Synthetic oligonucleotide
gctgggactacaagcgtgag

SEQ ID NO: 12853 - DNA, 20 bp, Artificial Sequence
  Description of Artificial Sequence: Synthetic oligonucleotide
ctgggactacaagcgtgagt

SEQ ID NO: 12854 - DNA, 20 bp, Artificial Sequence
  Description of Artificial Sequence: Synthetic oligonucleotide
tgggactacaagcgtgagtc

SEQ ID NO: 12855 - DNA, 20 bp, Artificial Sequence
  Description of Artificial Sequence: Synthetic oligonucleotide
gggactacaagcgtgagtca

SEQ ID NO: 12856 - DNA, 20 bp, Artificial Sequence
  Description of Artificial Sequence: Synthetic oligonucleotide
ggactacaagcgtgagtcac

SEQ ID NO: 12857 - DNA, 20 bp, Artificial Sequence
  Description of Artificial Sequence: Synthetic oligonucleotide
gactacaagcgtgagtcacc

SEQ ID NO: 12858 - DNA, 20 bp, Artificial Sequence
  Description of Artificial Sequence: Synthetic oligonucleotide
actacaagcgtgagtcaccg

SEQ ID NO: 12859 - DNA, 20 bp, Artificial Sequence
  Description of Artificial Sequence: Synthetic oligonucleotide
ctacaagcgtgagtcaccgc

SEQ ID NO: 12860 - DNA, 20 bp, Artificial Sequence
  Description of Artificial Sequence: Synthetic oligonucleotide
tacaagcgtgagtcaccgca

SEQ ID NO: 12861 - DNA, 20 bp, Artificial Sequence
  Description of Artificial Sequence: Synthetic oligonucleotide
acaagcgtgagtcaccgcac

SEQ ID NO: 12862 - DNA, 20 bp, Artificial Sequence
  Description of Artificial Sequence: Synthetic oligonucleotide
caagcgtgagtcaccgcacc

SEQ ID NO: 12863 - DNA, 20 bp, Artificial Sequence
  Description of Artificial Sequence: Synthetic oligonucleotide
aagcgtgagtcaccgcacct

SEQ ID NO: 12864 - DNA, 20 bp, Artificial Sequence
  Description of Artificial Sequence: Synthetic oligonucleotide
agcgtgagtcaccgcacctg

SEQ ID NO: 12865 - DNA, 20 bp, Artificial Sequence
  Description of Artificial Sequence: Synthetic oligonucleotide
gcgtgagtcaccgcacctgg

SEQ ID NO: 12866 - DNA, 20 bp, Artificial Sequence
  Description of Artificial Sequence: Synthetic oligonucleotide
cgtgagtcaccgcacctggc

SEQ ID NO: 12867 - DNA, 20 bp, Artificial Sequence
  Description of Artificial Sequence: Synthetic oligonucleotide
gtgagtcaccgcacctggct

SEQ ID NO: 12868 - DNA, 20 bp, Artificial Sequence
  Description of Artificial Sequence: Synthetic oligonucleotide
tgagtcaccgcacctggctt

SEQ ID NO: 12869 - DNA, 20 bp, Artificial Sequence
  Description of Artificial Sequence: Synthetic oligonucleotide
gagtcaccgcacctggcttt

SEQ ID NO: 12870 - DNA, 20 bp, Artificial Sequence
  Description of Artificial Sequence: Synthetic oligonucleotide
agtcaccgcacctggcttta

SEQ ID NO: 12871 - DNA, 20 bp, Artificial Sequence
  Description of Artificial Sequence: Synthetic oligonucleotide
gtcaccgcacctggctttat

SEQ ID NO: 12872 - DNA, 20 bp, Artificial Sequence
  Description of Artificial Sequence: Synthetic oligonucleotide
tcaccgcacctggctttatt

SEQ ID NO: 12873 - DNA, 20 bp, Artificial Sequence
  Description of Artificial Sequence: Synthetic oligonucleotide
caccgcacctggctttattt

SEQ ID NO: 12874 - DNA, 20 bp, Artificial Sequence
  Description of Artificial Sequence: Synthetic oligonucleotide
accgcacctggctttatttt

SEQ ID NO: 12875 - DNA, 20 bp, Artificial Sequence
  Description of Artificial Sequence: Synthetic oligonucleotide
ccgcacctggctttattttt

SEQ ID NO: 12876 - DNA, 20 bp, Artificial Sequence
  Description of Artificial Sequence: Synthetic oligonucleotide
cgcacctggctttattttta

SEQ ID NO: 12877 - DNA, 20 bp, Artificial Sequence
  Description of Artificial Sequence: Synthetic oligonucleotide
gcacctggctttatttttat

SEQ ID NO: 12878 - DNA, 20 bp, Artificial Sequence
  Description of Artificial Sequence: Synthetic oligonucleotide
cacctggctttatttttatt

SEQ ID NO: 12879 - DNA, 20 bp, Artificial Sequence
  Description of Artificial Sequence: Synthetic oligonucleotide
acctggctttatttttattt

SEQ ID NO: 12880 - DNA, 20 bp, Artificial Sequence
  Description of Artificial Sequence: Synthetic oligonucleotide
cctggctttatttttatttt

SEQ ID NO: 12881 - DNA, 20 bp, Artificial Sequence
  Description of Artificial Sequence: Synthetic oligonucleotide
ctggctttatttttatttta

SEQ ID NO: 12882 - DNA, 20 bp, Artificial Sequence
  Description of Artificial Sequence: Synthetic oligonucleotide
tggctttatttttattttat

SEQ ID NO: 12883 - DNA, 20 bp, Artificial Sequence
  Description of Artificial Sequence: Synthetic oligonucleotide
ggctttatttttattttatc

SEQ ID NO: 12884 - DNA, 20 bp, Artificial Sequence
  Description of Artificial Sequence: Synthetic oligonucleotide
gctttatttttattttatcg

SEQ ID NO: 12885 - DNA, 20 bp, Artificial Sequence
  Description of Artificial Sequence: Synthetic oligonucleotide
ctttatttttattttatcgc

SEQ ID NO: 12886 - DNA, 20 bp, Artificial Sequence
  Description of Artificial Sequence: Synthetic oligonucleotide
tttatttttattttatcgct

SEQ ID NO: 12887 - DNA, 20 bp, Artificial Sequence
  Description of Artificial Sequence: Synthetic oligonucleotide
ttatttttattttatcgcta

SEQ ID NO: 12888 - DNA, 20 bp, Artificial Sequence
  Description of Artificial Sequence: Synthetic oligonucleotide
tatttttattttatcgctat

SEQ ID NO: 12889 - DNA, 20 bp, Artificial Sequence
  Description of Artificial Sequence: Synthetic oligonucleotide
atttttattttatcgctatt

SEQ ID NO: 12890 - DNA, 20 bp, Artificial Sequence
  Description of Artificial Sequence: Synthetic oligonucleotide
tttttattttatcgctatta

SEQ ID NO: 12891 - DNA, 20 bp, Artificial Sequence
  Description of Artificial Sequence: Synthetic oligonucleotide
ttttattttatcgctattat

SEQ ID NO: 12892 - DNA, 20 bp, Artificial Sequence
  Description of Artificial Sequence: Synthetic oligonucleotide
tttattttatcgctattatt

SEQ ID NO: 12893 - DNA, 20 bp, Artificial Sequence
  Description of Artificial Sequence: Synthetic oligonucleotide
ttattttatcgctattattt

SEQ ID NO: 12894 - DNA, 20 bp, Artificial Sequence
  Description of Artificial Sequence: Synthetic oligonucleotide
tattttatcgctattatttt

SEQ ID NO: 12895 - DNA, 20 bp, Artificial Sequence
  Description of Artificial Sequence: Synthetic oligonucleotide
attttatcgctattattttt

SEQ ID NO: 12896 - DNA, 20 bp, Artificial Sequence
  Description of Artificial Sequence: Synthetic oligonucleotide
ttttatcgctattatttttt

SEQ ID NO: 12897 - DNA, 20 bp, Artificial Sequence
  Description of Artificial Sequence: Synthetic oligonucleotide
tttatcgctattattttttt

SEQ ID NO: 12898 - DNA, 20 bp, Artificial Sequence
  Description of Artificial Sequence: Synthetic oligonucleotide
ttatcgctattatttttttg

SEQ ID NO: 12899 - DNA, 20 bp, Artificial Sequence
  Description of Artificial Sequence: Synthetic oligonucleotide
tatcgctattatttttttga

SEQ ID NO: 12900 - DNA, 20 bp, Artificial Sequence
  Description of Artificial Sequence: Synthetic oligonucleotide
atcgctattatttttttgag

SEQ ID NO: 12901 - DNA, 20 bp, Artificial Sequence
  Description of Artificial Sequence: Synthetic oligonucleotide
tcgctattatttttttgagg

SEQ ID NO: 12902 - DNA, 20 bp, Artificial Sequence
  Description of Artificial Sequence: Synthetic oligonucleotide
cgctattatttttttgagga

SEQ ID NO: 12903 - DNA, 20 bp, Artificial Sequence
  Description of Artificial Sequence: Synthetic oligonucleotide
gctattatttttttgaggag

SEQ ID NO: 12904 - DNA, 20 bp, Artificial Sequence
  Description of Artificial Sequence: Synthetic oligonucleotide
ctattatttttttgaggagt

SEQ ID NO: 12905 - DNA, 20 bp, Artificial Sequence
  Description of Artificial Sequence: Synthetic oligonucleotide
tattatttttttgaggagtc

SEQ ID NO: 12906 - DNA, 20 bp, Artificial Sequence
  Description of Artificial Sequence: Synthetic oligonucleotide
attatttttttgaggagtct

SEQ ID NO: 12907 - DNA, 20 bp, Artificial Sequence
  Description of Artificial Sequence: Synthetic oligonucleotide
ttatttttttgaggagtctc

SEQ ID NO: 12908 - DNA, 20 bp, Artificial Sequence
  Description of Artificial Sequence: Synthetic oligonucleotide
tatttttttgaggagtctca

SEQ ID NO: 12909 - DNA, 20 bp, Artificial Sequence
  Description of Artificial Sequence: Synthetic oligonucleotide
atttttttgaggagtctcac

SEQ ID NO: 12910 - DNA, 20 bp, Artificial Sequence
  Description of Artificial Sequence: Synthetic oligonucleotide
tttttttgaggagtctcact

SEQ ID NO: 12911 - DNA, 20 bp, Artificial Sequence
  Description of Artificial Sequence: Synthetic oligonucleotide
ttttttgaggagtctcactc

SEQ ID NO: 12912 - DNA, 20 bp, Artificial Sequence
  Description of Artificial Sequence: Synthetic oligonucleotide
tttttgaggagtctcactct

SEQ ID NO: 12913 - DNA, 20 bp, Artificial Sequence
  Description of Artificial Sequence: Synthetic oligonucleotide
ttttgaggagtctcactctg

SEQ ID NO: 12914 - DNA, 20 bp, Artificial Sequence
  Description of Artificial Sequence: Synthetic oligonucleotide
tttgaggagtctcactctgt

SEQ ID NO: 12915 - DNA, 20 bp, Artificial Sequence
  Description of Artificial Sequence: Synthetic oligonucleotide
ttgaggagtctcactctgtt

SEQ ID NO: 12916 - DNA, 20 bp, Artificial Sequence
  Description of Artificial Sequence: Synthetic oligonucleotide
tgaggagtctcactctgttg

SEQ ID NO: 12917 - DNA, 20 bp, Artificial Sequence
  Description of Artificial Sequence: Synthetic oligonucleotide
gaggagtctcactctgttgc

SEQ ID NO: 12918 - DNA, 20 bp, Artificial Sequence
  Description of Artificial Sequence: Synthetic oligonucleotide
aggagtctcactctgttgcc

SEQ ID NO: 12919 - DNA, 20 bp, Artificial Sequence
  Description of Artificial Sequence: Synthetic oligonucleotide
ggagtctcactctgttgccc

SEQ ID NO: 12920 - DNA, 20 bp, Artificial Sequence
  Description of Artificial Sequence: Synthetic oligonucleotide
gagtctcactctgttgccca

SEQ ID NO: 12921 - DNA, 20 bp, Artificial Sequence
  Description of Artificial Sequence: Synthetic oligonucleotide
agtctcactctgttgcccag

SEQ ID NO: 12922 - DNA, 20 bp, Artificial Sequence
  Description of Artificial Sequence: Synthetic oligonucleotide
gtctcactctgttgcccagg

SEQ ID NO: 12923 - DNA, 20 bp, Artificial Sequence
  Description of Artificial Sequence: Synthetic oligonucleotide
tctcactctgttgcccaggc

SEQ ID NO: 12924 - DNA, 20 bp, Artificial Sequence
  Description of Artificial Sequence: Synthetic oligonucleotide
ctcactctgttgcccaggct

SEQ ID NO: 12925 - DNA, 20 bp, Artificial Sequence
  Description of Artificial Sequence: Synthetic oligonucleotide
tcactctgttgcccaggctg

SEQ ID NO: 12926 - DNA, 20 bp, Artificial Sequence
  Description of Artificial Sequence: Synthetic oligonucleotide
cactctgttgcccaggctgg

SEQ ID NO: 12927 - DNA, 20 bp, Artificial Sequence
  Description of Artificial Sequence: Synthetic oligonucleotide
actctgttgcccaggctgga

SEQ ID NO: 12928 - DNA, 20 bp, Artificial Sequence
  Description of Artificial Sequence: Synthetic oligonucleotide
ctctgttgcccaggctggag

SEQ ID NO: 12929 - DNA, 20 bp, Artificial Sequence
  Description of Artificial Sequence: Synthetic oligonucleotide
tctgttgcccaggctggagt

SEQ ID NO: 12930 - DNA, 20 bp, Artificial Sequence
  Description of Artificial Sequence: Synthetic oligonucleotide
ctgttgcccaggctggagtg

SEQ ID NO: 12931 - DNA, 20 bp, Artificial Sequence
  Description of Artificial Sequence: Synthetic oligonucleotide
tgttgcccaggctggagtgc

SEQ ID NO: 12932 - DNA, 20 bp, Artificial Sequence
  Description of Artificial Sequence: Synthetic oligonucleotide
gttgcccaggctggagtgca

SEQ ID NO: 12933 - DNA, 20 bp, Artificial Sequence
  Description of Artificial Sequence: Synthetic oligonucleotide
ttgcccaggctggagtgcag

SEQ ID NO: 12934 - DNA, 20 bp, Artificial Sequence
  Description of Artificial Sequence: Synthetic oligonucleotide
tgcccaggctggagtgcagt

SEQ ID NO: 12935 - DNA, 20 bp, Artificial Sequence
  Description of Artificial Sequence: Synthetic oligonucleotide
gcccaggctggagtgcagtg

SEQ ID NO: 12936 - DNA, 20 bp, Artificial Sequence
  Description of Artificial Sequence: Synthetic oligonucleotide
cccaggctggagtgcagtgc

SEQ ID NO: 12937 - DNA, 20 bp, Artificial Sequence
  Description of Artificial Sequence: Synthetic oligonucleotide
ccaggctggagtgcagtgct

SEQ ID NO: 12938 - DNA, 20 bp, Artificial Sequence
  Description of Artificial Sequence: Synthetic oligonucleotide
caggctggagtgcagtgctg

SEQ ID NO: 12939 - DNA, 20 bp, Artificial Sequence
  Description of Artificial Sequence: Synthetic oligonucleotide
aggctggagtgcagtgctgc

SEQ ID NO: 12940 - DNA, 20 bp, Artificial Sequence
  Description of Artificial Sequence: Synthetic oligonucleotide
ggctggagtgcagtgctgcg

SEQ ID NO: 12941 - DNA, 20 bp, Artificial Sequence
  Description of Artificial Sequence: Synthetic oligonucleotide
gctggagtgcagtgctgcga

SEQ ID NO: 12942 - DNA, 20 bp, Artificial Sequence
  Description of Artificial Sequence: Synthetic oligonucleotide
ctggagtgcagtgctgcgat

SEQ ID NO: 12943 - DNA, 20 bp, Artificial Sequence
  Description of Artificial Sequence: Synthetic oligonucleotide
tggagtgcagtgctgcgatc

SEQ ID NO: 12944 - DNA, 20 bp, Artificial Sequence
  Description of Artificial Sequence: Synthetic oligonucleotide
ggagtgcagtgctgcgatct

SEQ ID NO: 12945 - DNA, 20 bp, Artificial Sequence
  Description of Artificial Sequence: Synthetic oligonucleotide
gagtgcagtgctgcgatctc

SEQ ID NO: 12946 - DNA, 20 bp, Artificial Sequence
  Description of Artificial Sequence: Synthetic oligonucleotide
agtgcagtgctgcgatctcg

SEQ ID NO: 12947 - DNA, 20 bp, Artificial Sequence
  Description of Artificial Sequence: Synthetic oligonucleotide
gtgcagtgctgcgatctcgg

SEQ ID NO: 12948 - DNA, 20 bp, Artificial Sequence
  Description of Artificial Sequence: Synthetic oligonucleotide
tgcagtgctgcgatctcggc

SEQ ID NO: 12949 - DNA, 20 bp, Artificial Sequence
  Description of Artificial Sequence: Synthetic oligonucleotide
gcagtgctgcgatctcggct

SEQ ID NO: 12950 - DNA, 20 bp, Artificial Sequence
  Description of Artificial Sequence: Synthetic oligonucleotide
cagtgctgcgatctcggctc

SEQ ID NO: 12951 - DNA, 20 bp, Artificial Sequence
  Description of Artificial Sequence: Synthetic oligonucleotide
agtgctgcgatctcggctca

SEQ ID NO: 12952 - DNA, 20 bp, Artificial Sequence
  Description of Artificial Sequence: Synthetic oligonucleotide
gtgctgcgatctcggctcac

SEQ ID NO: 12953 - DNA, 20 bp, Artificial Sequence
  Description of Artificial Sequence: Synthetic oligonucleotide
tgctgcgatctcggctcact

SEQ ID NO: 12954 - DNA, 20 bp, Artificial Sequence
  Description of Artificial Sequence: Synthetic oligonucleotide
gctgcgatctcggctcactg

SEQ ID NO: 12955 - DNA, 20 bp, Artificial Sequence
  Description of Artificial Sequence: Synthetic oligonucleotide
ctgcgatctcggctcactgc

SEQ ID NO: 12956 - DNA, 20 bp, Artificial Sequence
  Description of Artificial Sequence: Synthetic oligonucleotide
tgcgatctcggctcactgca

SEQ ID NO: 12957 - DNA, 20 bp, Artificial Sequence
  Description of Artificial Sequence: Synthetic oligonucleotide
gcgatctcggctcactgcaa

SEQ ID NO: 12958 - DNA, 20 bp, Artificial Sequence
  Description of Artificial Sequence: Synthetic oligonucleotide
cgatctcggctcactgcaac

SEQ ID NO: 12959 - DNA, 20 bp, Artificial Sequence
  Description of Artificial Sequence: Synthetic oligonucleotide
gatctcggctcactgcaacc

SEQ ID NO: 12960 - DNA, 20 bp, Artificial Sequence
  Description of Artificial Sequence: Synthetic oligonucleotide
atctcggctcactgcaacct

SEQ ID NO: 12961 - DNA, 20 bp, Artificial Sequence
  Description of Artificial Sequence: Synthetic oligonucleotide
tctcggctcactgcaacctc

SEQ ID NO: 12962 - DNA, 20 bp, Artificial Sequence
  Description of Artificial Sequence: Synthetic oligonucleotide
ctcggctcactgcaacctct

SEQ ID NO: 12963 - DNA, 20 bp, Artificial Sequence
  Description of Artificial Sequence: Synthetic oligonucleotide
tcggctcactgcaacctctg

SEQ ID NO: 12964 - DNA, 20 bp, Artificial Sequence
  Description of Artificial Sequence: Synthetic oligonucleotide
cggctcactgcaacctctgc

SEQ ID NO: 12965 - DNA, 20 bp, Artificial Sequence
  Description of Artificial Sequence: Synthetic oligonucleotide
ggctcactgcaacctctgcc

SEQ ID NO: 12966 - DNA, 20 bp, Artificial Sequence
  Description of Artificial Sequence: Synthetic oligonucleotide
gctcactgcaacctctgcct

SEQ ID NO: 12967 - DNA, 20 bp, Artificial Sequence
  Description of Artificial Sequence: Synthetic oligonucleotide
ctcactgcaacctctgcctc

SEQ ID NO: 12968 - DNA, 20 bp, Artificial Sequence
  Description of Artificial Sequence: Synthetic oligonucleotide
tcactgcaacctctgcctcc

SEQ ID NO: 12969 - DNA, 20 bp, Artificial Sequence
  Description of Artificial Sequence: Synthetic oligonucleotide
cactgcaacctctgcctccc

SEQ ID NO: 12970 - DNA, 20 bp, Artificial Sequence
  Description of Artificial Sequence: Synthetic oligonucleotide
actgcaacctctgcctcccg

SEQ ID NO: 12971 - DNA, 20 bp, Artificial Sequence
  Description of Artificial Sequence: Synthetic oligonucleotide
ctgcaacctctgcctcccgg

SEQ ID NO: 12972 - DNA, 20 bp, Artificial Sequence
  Description of Artificial Sequence: Synthetic oligonucleotide
tgcaacctctgcctcccggg

SEQ ID NO: 12973 - DNA, 20 bp, Artificial Sequence
  Description of Artificial Sequence: Synthetic oligonucleotide
gcaacctctgcctcccgggt

SEQ ID NO: 12974 - DNA, 20 bp, Artificial Sequence
  Description of Artificial Sequence: Synthetic oligonucleotide
caacctctgcctcccgggtt

SEQ ID NO: 12975 - DNA, 20 bp, Artificial Sequence
  Description of Artificial Sequence: Synthetic oligonucleotide
aacctctgcctcccgggttc

SEQ ID NO: 12976 - DNA, 20 bp, Artificial Sequence
  Description of Artificial Sequence: Synthetic oligonucleotide
acctctgcctcccgggttca

SEQ ID NO: 12977 - DNA, 20 bp, Artificial Sequence
  Description of Artificial Sequence: Synthetic oligonucleotide
cctctgcctcccgggttcaa

SEQ ID NO: 12978 - DNA, 20 bp, Artificial Sequence
  Description of Artificial Sequence: Synthetic oligonucleotide
ctctgcctcccgggttcaag

SEQ ID NO: 12979 - DNA, 20 bp, Artificial Sequence
  Description of Artificial Sequence: Synthetic oligonucleotide
tctgcctcccgggttcaaga

SEQ ID NO: 12980 - DNA, 20 bp, Artificial Sequence
  Description of Artificial Sequence: Synthetic oligonucleotide
ctgcctcccgggttcaagag

SEQ ID NO: 12981 - DNA, 20 bp, Artificial Sequence
  Description of Artificial Sequence: Synthetic oligonucleotide
tgcctcccgggttcaagaga

SEQ ID NO: 12982 - DNA, 20 bp, Artificial Sequence
  Description of Artificial Sequence: Synthetic oligonucleotide
gcctcccgggttcaagagat

SEQ ID NO: 12983 - DNA, 20 bp, Artificial Sequence
  Description of Artificial Sequence: Synthetic oligonucleotide
cctcccgggttcaagagatt

SEQ ID NO: 12984 - DNA, 20 bp, Artificial Sequence
  Description of Artificial Sequence: Synthetic oligonucleotide
ctcccgggttcaagagattc

SEQ ID NO: 12985 - DNA, 20 bp, Artificial Sequence
  Description of Artificial Sequence: Synthetic oligonucleotide
tcccgggttcaagagattct

SEQ ID NO: 12986 - DNA, 20 bp, Artificial Sequence
  Description of Artificial Sequence: Synthetic oligonucleotide
cccgggttcaagagattctc

SEQ ID NO: 12987 - DNA, 20 bp, Artificial Sequence
  Description of Artificial Sequence: Synthetic oligonucleotide
ccgggttcaagagattctcc

SEQ ID NO: 12988 - DNA, 20 bp, Artificial Sequence
  Description of Artificial Sequence: Synthetic oligonucleotide
cgggttcaagagattctcct

SEQ ID NO: 12989 - DNA, 20 bp, Artificial Sequence
  Description of Artificial Sequence: Synthetic oligonucleotide
gggttcaagagattctcctg

SEQ ID NO: 12990 - DNA, 20 bp, Artificial Sequence
  Description of Artificial Sequence: Synthetic oligonucleotide
ggttcaagagattctcctgc

SEQ ID NO: 12991 - DNA, 20 bp, Artificial Sequence
  Description of Artificial Sequence: Synthetic oligonucleotide
gttcaagagattctcctgcc

SEQ ID NO: 12992 - DNA, 20 bp, Artificial Sequence
  Description of Artificial Sequence: Synthetic oligonucleotide
ttcaagagattctcctgcct

SEQ ID NO: 12993 - DNA, 20 bp, Artificial Sequence
  Description of Artificial Sequence: Synthetic oligonucleotide
tcaagagattctcctgcctc

SEQ ID NO: 12994 - DNA, 20 bp, Artificial Sequence
  Description of Artificial Sequence: Synthetic oligonucleotide
caagagattctcctgcctca

SEQ ID NO: 12995 - DNA, 20 bp, Artificial Sequence
  Description of Artificial Sequence: Synthetic oligonucleotide
aagagattctcctgcctcag

SEQ ID NO: 12996 - DNA, 20 bp, Artificial Sequence
  Description of Artificial Sequence: Synthetic oligonucleotide
agagattctcctgcctcagc

SEQ ID NO: 12997 - DNA, 20 bp, Artificial Sequence
  Description of Artificial Sequence: Synthetic oligonucleotide
gagattctcctgcctcagcc

SEQ ID NO: 12998 - DNA, 20 bp, Artificial Sequence
  Description of Artificial Sequence: Synthetic oligonucleotide
agattctcctgcctcagcct

SEQ ID NO: 12999 - DNA, 20 bp, Artificial Sequence
  Description of Artificial Sequence: Synthetic oligonucleotide
gattctcctgcctcagcctc

SEQ ID NO: 13000 - DNA, 20 bp, Artificial Sequence
  Description of Artificial Sequence: Synthetic oligonucleotide
attctcctgcctcagcctcc

SEQ ID NO: 13001 - DNA, 20 bp, Artificial Sequence
  Description of Artificial Sequence: Synthetic oligonucleotide
ttctcctgcctcagcctccc

SEQ ID NO: 13002 - DNA, 20 bp, Artificial Sequence
  Description of Artificial Sequence: Synthetic oligonucleotide
tctcctgcctcagcctccca

SEQ ID NO: 13003 - DNA, 20 bp, Artificial Sequence
  Description of Artificial Sequence: Synthetic oligonucleotide
ctcctgcctcagcctcccaa

SEQ ID NO: 13004 - DNA, 20 bp, Artificial Sequence
  Description of Artificial Sequence: Synthetic oligonucleotide
tcctgcctcagcctcccaag

SEQ ID NO: 13005 - DNA, 20 bp, Artificial Sequence
  Description of Artificial Sequence: Synthetic oligonucleotide
cctgcctcagcctcccaagt

SEQ ID NO: 13006 - DNA, 20 bp, Artificial Sequence
  Description of Artificial Sequence: Synthetic oligonucleotide
ctgcctcagcctcccaagta

SEQ ID NO: 13007 - DNA, 20 bp, Artificial Sequence
  Description of Artificial Sequence: Synthetic oligonucleotide
tgcctcagcctcccaagtag

SEQ ID NO: 13008 - DNA, 20 bp, Artificial Sequence
  Description of Artificial Sequence: Synthetic oligonucleotide
gcctcagcctcccaagtagc

SEQ ID NO: 13009 - DNA, 20 bp, Artificial Sequence
  Description of Artificial Sequence: Synthetic oligonucleotide
cctcagcctcccaagtagct

SEQ ID NO: 13010 - DNA, 20 bp, Artificial Sequence
  Description of Artificial Sequence: Synthetic oligonucleotide
ctcagcctcccaagtagctg

SEQ ID NO: 13011 - DNA, 20 bp, Artificial Sequence
  Description of Artificial Sequence: Synthetic oligonucleotide
tcagcctcccaagtagctgg

SEQ ID NO: 13012 - DNA, 20 bp, Artificial Sequence
  Description of Artificial Sequence: Synthetic oligonucleotide
cagcctcccaagtagctggg

SEQ ID NO: 13013 - DNA, 20 bp, Artificial Sequence
  Description of Artificial Sequence: Synthetic oligonucleotide
agcctcccaagtagctggga

SEQ ID NO: 13014 - DNA, 20 bp, Artificial Sequence
  Description of Artificial Sequence: Synthetic oligonucleotide
gcctcccaagtagctgggat

SEQ ID NO: 13015 - DNA, 20 bp, Artificial Sequence
  Description of Artificial Sequence: Synthetic oligonucleotide
cctcccaagtagctgggatt

SEQ ID NO: 13016 - DNA, 20 bp, Artificial Sequence
  Description of Artificial Sequence: Synthetic oligonucleotide
ctcccaagtagctgggatta

SEQ ID NO: 13017 - DNA, 20 bp, Artificial Sequence
  Description of Artificial Sequence: Synthetic oligonucleotide
tcccaagtagctgggattac

SEQ ID NO: 13018 - DNA, 20 bp, Artificial Sequence
  Description of Artificial Sequence: Synthetic oligonucleotide
cccaagtagctgggattaca

SEQ ID NO: 13019 - DNA, 20 bp, Artificial Sequence
  Description of Artificial Sequence: Synthetic oligonucleotide
ccaagtagctgggattacag

SEQ ID NO: 13020 - DNA, 20 bp, Artificial Sequence
  Description of Artificial Sequence: Synthetic oligonucleotide
caagtagctgggattacagg

SEQ ID NO: 13021 - DNA, 20 bp, Artificial Sequence
  Description of Artificial Sequence: Synthetic oligonucleotide
aagtagctgggattacaggc

SEQ ID NO: 13022 - DNA, 20 bp, Artificial Sequence
  Description of Artificial Sequence: Synthetic oligonucleotide
agtagctgggattacaggca

SEQ ID NO: 13023 - DNA, 20 bp, Artificial Sequence
  Description of Artificial Sequence: Synthetic oligonucleotide
gtagctgggattacaggcat

SEQ ID NO: 13024 - DNA, 20 bp, Artificial Sequence
  Description of Artificial Sequence: Synthetic oligonucleotide
tagctgggattacaggcatg

SEQ ID NO: 13025 - DNA, 20 bp, Artificial Sequence
  Description of Artificial Sequence: Synthetic oligonucleotide
agctgggattacaggcatgc

SEQ ID NO: 13026 - DNA, 20 bp, Artificial Sequence
  Description of Artificial Sequence: Synthetic oligonucleotide
gctgggattacaggcatgca

SEQ ID NO: 13027 - DNA, 20 bp, Artificial Sequence
  Description of Artificial Sequence: Synthetic oligonucleotide
ctgggattacaggcatgcac

SEQ ID NO: 13028 - DNA, 20 bp, Artificial Sequence
  Description of Artificial Sequence: Synthetic oligonucleotide
tgggattacaggcatgcaca

SEQ ID NO: 13029 - DNA, 20 bp, Artificial Sequence
  Description of Artificial Sequence: Synthetic oligonucleotide
gggattacaggcatgcacac

SEQ ID NO: 13030 - DNA, 20 bp, Artificial Sequence
  Description of Artificial Sequence: Synthetic oligonucleotide
ggattacaggcatgcacacc

SEQ ID NO: 13031 - DNA, 20 bp, Artificial Sequence
  Description of Artificial Sequence: Synthetic oligonucleotide
gattacaggcatgcacacca

SEQ ID NO: 13032 - DNA, 20 bp, Artificial Sequence
  Description of Artificial Sequence: Synthetic oligonucleotide
attacaggcatgcacaccat

SEQ ID NO: 13033 - DNA, 20 bp, Artificial Sequence
  Description of Artificial Sequence: Synthetic oligonucleotide
ttacaggcatgcacaccatg

SEQ ID NO: 13034 - DNA, 20 bp, Artificial Sequence
  Description of Artificial Sequence: Synthetic oligonucleotide
tacaggcatgcacaccatgc

SEQ ID NO: 13035 - DNA, 20 bp, Artificial Sequence
  Description of Artificial Sequence: Synthetic oligonucleotide
acaggcatgcacaccatgcc

SEQ ID NO: 13036 - DNA, 20 bp, Artificial Sequence
  Description of Artificial Sequence: Synthetic oligonucleotide
caggcatgcacaccatgcca

SEQ ID NO: 13037 - DNA, 20 bp, Artificial Sequence
  Description of Artificial Sequence: Synthetic oligonucleotide
aggcatgcacaccatgccag

SEQ ID NO: 13038 - DNA, 20 bp, Artificial Sequence
  Description of Artificial Sequence: Synthetic oligonucleotide
ggcatgcacaccatgccagg

SEQ ID NO: 13039 - DNA, 20 bp, Artificial Sequence
  Description of Artificial Sequence: Synthetic oligonucleotide
gcatgcacaccatgccaggc

SEQ ID NO: 13040 - DNA, 20 bp, Artificial Sequence
  Description of Artificial Sequence: Synthetic oligonucleotide
catgcacaccatgccaggct

SEQ ID NO: 13041 - DNA, 20 bp, Artificial Sequence
  Description of Artificial Sequence: Synthetic oligonucleotide
atgcacaccatgccaggcta

SEQ ID NO: 13042 - DNA, 20 bp, Artificial Sequence
  Description of Artificial Sequence: Synthetic oligonucleotide
tgcacaccatgccaggctaa

SEQ ID NO: 13043 - DNA, 20 bp, Artificial Sequence
  Description of Artificial Sequence: Synthetic oligonucleotide
gcacaccatgccaggctaat

SEQ ID NO: 13044 - DNA, 20 bp, Artificial Sequence
  Description of Artificial Sequence: Synthetic oligonucleotide
cacaccatgccaggctaatt

SEQ ID NO: 13045 - DNA, 20 bp, Artificial Sequence
  Description of Artificial Sequence: Synthetic oligonucleotide
acaccatgccaggctaattt

SEQ ID NO: 13046 - DNA, 20 bp, Artificial Sequence
  Description of Artificial Sequence: Synthetic oligonucleotide
caccatgccaggctaatttt

SEQ ID NO: 13047 - DNA, 20 bp, Artificial Sequence
  Description of Artificial Sequence: Synthetic oligonucleotide
accatgccaggctaattttt

SEQ ID NO: 13048 - DNA, 20 bp, Artificial Sequence
  Description of Artificial Sequence: Synthetic oligonucleotide
ccatgccaggctaatttttt

SEQ ID NO: 13049 - DNA, 20 bp, Artificial Sequence
  Description of Artificial Sequence: Synthetic oligonucleotide
catgccaggctaattttttg

SEQ ID NO: 13050 - DNA, 20 bp, Artificial Sequence
  Description of Artificial Sequence: Synthetic oligonucleotide
atgccaggctaattttttgt

SEQ ID NO: 13051 - DNA, 20 bp, Artificial Sequence
  Description of Artificial Sequence: Synthetic oligonucleotide
tgccaggctaattttttgta

SEQ ID NO: 13052 - DNA, 20 bp, Artificial Sequence
  Description of Artificial Sequence: Synthetic oligonucleotide
gccaggctaattttttgtat

SEQ ID NO: 13053 - DNA, 20 bp, Artificial Sequence
  Description of Artificial Sequence: Synthetic oligonucleotide
ccaggctaattttttgtatt

SEQ ID NO: 13054 - DNA, 20 bp, Artificial Sequence
  Description of Artificial Sequence: Synthetic oligonucleotide
caggctaattttttgtattt

SEQ ID NO: 13055 - DNA, 20 bp, Artificial Sequence
  Description of Artificial Sequence: Synthetic oligonucleotide
aggctaattttttgtatttt

SEQ ID NO: 13056 - DNA, 20 bp, Artificial Sequence
  Description of Artificial Sequence: Synthetic oligonucleotide
ggctaattttttgtattttt

SEQ ID NO: 13057 - DNA, 20 bp, Artificial Sequence
  Description of Artificial Sequence: Synthetic oligonucleotide
gctaattttttgtattttta

SEQ ID NO: 13058 - DNA, 20 bp, Artificial Sequence
  Description of Artificial Sequence: Synthetic oligonucleotide
ctaattttttgtatttttag

SEQ ID NO: 13059 - DNA, 20 bp, Artificial Sequence
  Description of Artificial Sequence: Synthetic oligonucleotide
taattttttgtatttttagt

SEQ ID NO: 13060 - DNA, 20 bp, Artificial Sequence
  Description of Artificial Sequence: Synthetic oligonucleotide
aattttttgtatttttagta

SEQ ID NO: 13061 - DNA, 20 bp, Artificial Sequence
  Description of Artificial Sequence: Synthetic oligonucleotide
attttttgtatttttagtag

SEQ ID NO: 13062 - DNA, 20 bp, Artificial Sequence
  Description of Artificial Sequence: Synthetic oligonucleotide
ttttttgtatttttagtaga

SEQ ID NO: 13063 - DNA, 20 bp, Artificial Sequence
  Description of Artificial Sequence: Synthetic oligonucleotide
tttttgtatttttagtagag

SEQ ID NO: 13064 - DNA, 20 bp, Artificial Sequence
  Description of Artificial Sequence: Synthetic oligonucleotide
ttttgtatttttagtagaga

SEQ ID NO: 13065 - DNA, 20 bp, Artificial Sequence
  Description of Artificial Sequence: Synthetic oligonucleotide
tttgtatttttagtagagac

SEQ ID NO: 13066 - DNA, 20 bp, Artificial Sequence
  Description of Artificial Sequence: Synthetic oligonucleotide
ttgtatttttagtagagacg

SEQ ID NO: 13067 - DNA, 20 bp, Artificial Sequence
  Description of Artificial Sequence: Synthetic oligonucleotide
tgtatttttagtagagacga

SEQ ID NO: 13068 - DNA, 20 bp, Artificial Sequence
  Description of Artificial Sequence: Synthetic oligonucleotide
gtatttttagtagagacgag

SEQ ID NO: 13069 - DNA, 20 bp, Artificial Sequence
  Description of Artificial Sequence: Synthetic oligonucleotide
tatttttagtagagacgagg

SEQ ID NO: 13070 - DNA, 20 bp, Artificial Sequence
  Description of Artificial Sequence: Synthetic oligonucleotide
atttttagtagagacgaggt

SEQ ID NO: 13071 - DNA, 20 bp, Artificial Sequence
  Description of Artificial Sequence: Synthetic oligonucleotide
tttttagtagagacgaggtt

SEQ ID NO: 13072 - DNA, 20 bp, Artificial Sequence
  Description of Artificial Sequence: Synthetic oligonucleotide
ttttagtagagacgaggttt

SEQ ID NO: 13073 - DNA, 20 bp, Artificial Sequence
  Description of Artificial Sequence: Synthetic oligonucleotide
tttagtagagacgaggtttc

SEQ ID NO: 13074 - DNA, 20 bp, Artificial Sequence
  Description of Artificial Sequence: Synthetic oligonucleotide
ttagtagagacgaggtttct

SEQ ID NO: 13075 - DNA, 20 bp, Artificial Sequence
  Description of Artificial Sequence: Synthetic oligonucleotide
tagtagagacgaggtttctc

SEQ ID NO: 13076 - DNA, 20 bp, Artificial Sequence
  Description of Artificial Sequence: Synthetic oligonucleotide
agtagagacgaggtttctcc

SEQ ID NO: 13077 - DNA, 20 bp, Artificial Sequence
  Description of Artificial Sequence: Synthetic oligonucleotide
gtagagacgaggtttctcca

SEQ ID NO: 13078 - DNA, 20 bp, Artificial Sequence
  Description of Artificial Sequence: Synthetic oligonucleotide
tagagacgaggtttctccat

SEQ ID NO: 13079 - DNA, 20 bp, Artificial Sequence
  Description of Artificial Sequence: Synthetic oligonucleotide
agagacgaggtttctccatg

SEQ ID NO: 13080 - DNA, 20 bp, Artificial Sequence
  Description of Artificial Sequence: Synthetic oligonucleotide
gagacgaggtttctccatgt

SEQ ID NO: 13081 - DNA, 20 bp, Artificial Sequence
  Description of Artificial Sequence: Synthetic oligonucleotide
agacgaggtttctccatgtt

SEQ ID NO: 13082 - DNA, 20 bp, Artificial Sequence
  Description of Artificial Sequence: Synthetic oligonucleotide
gacgaggtttctccatgttg

SEQ ID NO: 13083 - DNA, 20 bp, Artificial Sequence
  Description of Artificial Sequence: Synthetic oligonucleotide
acgaggtttctccatgttgg

SEQ ID NO: 13084 - DNA, 20 bp, Artificial Sequence
  Description of Artificial Sequence: Synthetic oligonucleotide
cgaggtttctccatgttggc

SEQ ID NO: 13085 - DNA, 20 bp, Artificial Sequence
  Description of Artificial Sequence: Synthetic oligonucleotide
gaggtttctccatgttggcc

SEQ ID NO: 13086 - DNA, 20 bp, Artificial Sequence
  Description of Artificial Sequence: Synthetic oligonucleotide
aggtttctccatgttggcca

SEQ ID NO: 13087 - DNA, 20 bp, Artificial Sequence
  Description of Artificial Sequence: Synthetic oligonucleotide
ggtttctccatgttggccag

SEQ ID NO: 13088 - DNA, 20 bp, Artificial Sequence
  Description of Artificial Sequence: Synthetic oligonucleotide
gtttctccatgttggccagg

SEQ ID NO: 13089 - DNA, 20 bp, Artificial Sequence
  Description of Artificial Sequence: Synthetic oligonucleotide
tttctccatgttggccaggc

SEQ ID NO: 13090 - DNA, 20 bp, Artificial Sequence
  Description of Artificial Sequence: Synthetic oligonucleotide
ttctccatgttggccaggct

SEQ ID NO: 13091 - DNA, 20 bp, Artificial Sequence
  Description of Artificial Sequence: Synthetic oligonucleotide
tctccatgttggccaggcta

SEQ ID NO: 13092 - DNA, 20 bp, Artificial Sequence
  Description of Artificial Sequence: Synthetic oligonucleotide
ctccatgttggccaggctag

SEQ ID NO: 13093 - DNA, 20 bp, Artificial Sequence
  Description of Artificial Sequence: Synthetic oligonucleotide
tccatgttggccaggctagt

SEQ ID NO: 13094 - DNA, 20 bp, Artificial Sequence
  Description of Artificial Sequence: Synthetic oligonucleotide
ccatgttggccaggctagtc

SEQ ID NO: 13095 - DNA, 20 bp, Artificial Sequence
  Description of Artificial Sequence: Synthetic oligonucleotide
catgttggccaggctagtct

SEQ ID NO: 13096 - DNA, 20 bp, Artificial Sequence
  Description of Artificial Sequence: Synthetic oligonucleotide
atgttggccaggctagtctc

SEQ ID NO: 13097 - DNA, 20 bp, Artificial Sequence
  Description of Artificial Sequence: Synthetic oligonucleotide
tgttggccaggctagtctcg

SEQ ID NO: 13098 - DNA, 20 bp, Artificial Sequence
  Description of Artificial Sequence: Synthetic oligonucleotide
gttggccaggctagtctcga

SEQ ID NO: 13099 - DNA, 20 bp, Artificial Sequence
  Description of Artificial Sequence: Synthetic oligonucleotide
ttggccaggctagtctcgac

SEQ ID NO: 13100 - DNA, 20 bp, Artificial Sequence
  Description of Artificial Sequence: Synthetic oligonucleotide
tggccaggctagtctcgaca

SEQ ID NO: 13101 - DNA, 20 bp, Artificial Sequence
  Description of Artificial Sequence: Synthetic oligonucleotide
ggccaggctagtctcgacag

SEQ ID NO: 13102 - DNA, 20 bp, Artificial Sequence
  Description of Artificial Sequence: Synthetic oligonucleotide
gccaggctagtctcgacagc

SEQ ID NO: 13103 - DNA, 20 bp, Artificial Sequence
  Description of Artificial Sequence: Synthetic oligonucleotide
ccaggctagtctcgacagca

SEQ ID NO: 13104 - DNA, 20 bp, Artificial Sequence
  Description of Artificial Sequence: Synthetic oligonucleotide
caggctagtctcgacagcag

SEQ ID NO: 13105 - DNA, 20 bp, Artificial Sequence
  Description of Artificial Sequence: Synthetic oligonucleotide
aggctagtctcgacagcagg

SEQ ID NO: 13106 - DNA, 20 bp, Artificial Sequence
  Description of Artificial Sequence: Synthetic oligonucleotide
ggctagtctcgacagcaggt

SEQ ID NO: 13107 - DNA, 20 bp, Artificial Sequence
  Description of Artificial Sequence: Synthetic oligonucleotide
gctagtctcgacagcaggtg

SEQ ID NO: 13108 - DNA, 20 bp, Artificial Sequence
  Description of Artificial Sequence: Synthetic oligonucleotide
ctagtctcgacagcaggtgg

SEQ ID NO: 13109 - DNA, 20 bp, Artificial Sequence
  Description of Artificial Sequence: Synthetic oligonucleotide
tagtctcgacagcaggtgga

SEQ ID NO: 13110 - DNA, 20 bp, Artificial Sequence
  Description of Artificial Sequence: Synthetic oligonucleotide
agtctcgacagcaggtggag

SEQ ID NO: 13111 - DNA, 20 bp, Artificial Sequence
  Description of Artificial Sequence: Synthetic oligonucleotide
gtctcgacagcaggtggagg

SEQ ID NO: 13112 - DNA, 20 bp, Artificial Sequence
  Description of Artificial Sequence: Synthetic oligonucleotide
tctcgacagcaggtggaggc

SEQ ID NO: 13113 - DNA, 20 bp, Artificial Sequence
  Description of Artificial Sequence: Synthetic oligonucleotide
ctcgacagcaggtggaggct

SEQ ID NO: 13114 - DNA, 20 bp, Artificial Sequence
  Description of Artificial Sequence: Synthetic oligonucleotide
tcgacagcaggtggaggctc

SEQ ID NO: 13115 - DNA, 20 bp, Artificial Sequence
  Description of Artificial Sequence: Synthetic oligonucleotide
cgacagcaggtggaggctcc

SEQ ID NO: 13116 - DNA, 20 bp, Artificial Sequence
  Description of Artificial Sequence: Synthetic oligonucleotide
gacagcaggtggaggctccg

SEQ ID NO: 13117 - DNA, 20 bp, Artificial Sequence
  Description of Artificial Sequence: Synthetic oligonucleotide
acagcaggtggaggctccgt

SEQ ID NO: 13118 - DNA, 20 bp, Artificial Sequence
  Description of Artificial Sequence: Synthetic oligonucleotide
cagcaggtggaggctccgtg

SEQ ID NO: 13119 - DNA, 20 bp, Artificial Sequence
  Description of Artificial Sequence: Synthetic oligonucleotide
agcaggtggaggctccgtga

SEQ ID NO: 13120 - DNA, 20 bp, Artificial Sequence
  Description of Artificial Sequence: Synthetic oligonucleotide
gcaggtggaggctccgtgag

SEQ ID NO: 13121 - DNA, 20 bp, Artificial Sequence
  Description of Artificial Sequence: Synthetic oligonucleotide
caggtggaggctccgtgagc

SEQ ID NO: 13122 - DNA, 20 bp, Artificial Sequence
  Description of Artificial Sequence: Synthetic oligonucleotide
aggtggaggctccgtgagcc

SEQ ID NO: 13123 - DNA, 20 bp, Artificial Sequence
  Description of Artificial Sequence: Synthetic oligonucleotide
ggtggaggctccgtgagcca

SEQ ID NO: 13124 - DNA, 20 bp, Artificial Sequence
  Description of Artificial Sequence: Synthetic oligonucleotide
gtggaggctccgtgagccac

SEQ ID NO: 13125 - DNA, 20 bp, Artificial Sequence
  Description of Artificial Sequence: Synthetic oligonucleotide
tggaggctccgtgagccact

SEQ ID NO: 13126 - DNA, 20 bp, Artificial Sequence
  Description of Artificial Sequence: Synthetic oligonucleotide
ggaggctccgtgagccactg

SEQ ID NO: 13127 - DNA, 20 bp, Artificial Sequence
  Description of Artificial Sequence: Synthetic oligonucleotide
gaggctccgtgagccactgc

SEQ ID NO: 13128 - DNA, 20 bp, Artificial Sequence
  Description of Artificial Sequence: Synthetic oligonucleotide
aggctccgtgagccactgcg

SEQ ID NO: 13129 - DNA, 20 bp, Artificial Sequence
  Description of Artificial Sequence: Synthetic oligonucleotide
ggctccgtgagccactgcgc

SEQ ID NO: 13130 - DNA, 20 bp, Artificial Sequence
  Description of Artificial Sequence: Synthetic oligonucleotide
gctccgtgagccactgcgcc

SEQ ID NO: 13131 - DNA, 20 bp, Artificial Sequence
  Description of Artificial Sequence: Synthetic oligonucleotide
ctccgtgagccactgcgccc

SEQ ID NO: 13132 - DNA, 20 bp, Artificial Sequence
  Description of Artificial Sequence: Synthetic oligonucleotide
tccgtgagccactgcgcccg

SEQ ID NO: 13133 - DNA, 20 bp, Artificial Sequence
  Description of Artificial Sequence: Synthetic oligonucleotide
ccgtgagccactgcgcccgg

SEQ ID NO: 13134 - DNA, 20 bp, Artificial Sequence
  Description of Artificial Sequence: Synthetic oligonucleotide
cgtgagccactgcgcccggt

SEQ ID NO: 13135 - DNA, 20 bp, Artificial Sequence
  Description of Artificial Sequence: Synthetic oligonucleotide
gtgagccactgcgcccggtc

SEQ ID NO: 13136 - DNA, 20 bp, Artificial Sequence
  Description of Artificial Sequence: Synthetic oligonucleotide
tgagccactgcgcccggtcg

SEQ ID NO: 13137 - DNA, 20 bp, Artificial Sequence
  Description of Artificial Sequence: Synthetic oligonucleotide
gagccactgcgcccggtcgt

SEQ ID NO: 13138 - DNA, 20 bp, Artificial Sequence
  Description of Artificial Sequence: Synthetic oligonucleotide
agccactgcgcccggtcgtt

SEQ ID NO: 13139 - DNA, 20 bp, Artificial Sequence
  Description of Artificial Sequence: Synthetic oligonucleotide
gccactgcgcccggtcgttt

SEQ ID NO: 13140 - DNA, 20 bp, Artificial Sequence
  Description of Artificial Sequence: Synthetic oligonucleotide
ccactgcgcccggtcgtttt

SEQ ID NO: 13141 - DNA, 20 bp, Artificial Sequence
  Description of Artificial Sequence: Synthetic oligonucleotide
cactgcgcccggtcgttttt

SEQ ID NO: 13142 - DNA, 20 bp, Artificial Sequence
  Description of Artificial Sequence: Synthetic oligonucleotide
actgcgcccggtcgtttttt

SEQ ID NO: 13143 - DNA, 20 bp, Artificial Sequence
  Description of Artificial Sequence: Synthetic oligonucleotide
ctgcgcccggtcgtttttta

SEQ ID NO: 13144 - DNA, 20 bp, Artificial Sequence
  Description of Artificial Sequence: Synthetic oligonucleotide
tgcgcccggtcgttttttaa

SEQ ID NO: 13145 - DNA, 20 bp, Artificial Sequence
  Description of Artificial Sequence: Synthetic oligonucleotide
gcgcccggtcgttttttaat

SEQ ID NO: 13146 - DNA, 20 bp, Artificial Sequence
  Description of Artificial Sequence: Synthetic oligonucleotide
cgcccggtcgttttttaatt

SEQ ID NO: 13147 - DNA, 20 bp, Artificial Sequence
  Description of Artificial Sequence: Synthetic oligonucleotide
gcccggtcgttttttaattt

SEQ ID NO: 13148 - DNA, 20 bp, Artificial Sequence
  Description of Artificial Sequence: Synthetic oligonucleotide
cccggtcgttttttaatttt

SEQ ID NO: 13149 - DNA, 20 bp, Artificial Sequence
  Description of Artificial Sequence: Synthetic oligonucleotide
ccggtcgttttttaatttta

SEQ ID NO: 13150 - DNA, 20 bp, Artificial Sequence
  Description of Artificial Sequence: Synthetic oligonucleotide
cggtcgttttttaattttat

SEQ ID NO: 13151 - DNA, 20 bp, Artificial Sequence
  Description of Artificial Sequence: Synthetic oligonucleotide
ggtcgttttttaattttata

SEQ ID NO: 13152 - DNA, 20 bp, Artificial Sequence
  Description of Artificial Sequence: Synthetic oligonucleotide
gtcgttttttaattttatat

SEQ ID NO: 13153 - DNA, 20 bp, Artificial Sequence
  Description of Artificial Sequence: Synthetic oligonucleotide
tcgttttttaattttatatt

SEQ ID NO: 13154 - DNA, 20 bp, Artificial Sequence
  Description of Artificial Sequence: Synthetic oligonucleotide
cgttttttaattttatattt

SEQ ID NO: 13155 - DNA, 20 bp, Artificial Sequence
  Description of Artificial Sequence: Synthetic oligonucleotide
gttttttaattttatattta

SEQ ID NO: 13156 - DNA, 20 bp, Artificial Sequence
  Description of Artificial Sequence: Synthetic oligonucleotide
ttttttaattttatatttat

SEQ ID NO: 13157 - DNA, 20 bp, Artificial Sequence
  Description of Artificial Sequence: Synthetic oligonucleotide
tttttaattttatatttatt

SEQ ID NO: 13158 - DNA, 20 bp, Artificial Sequence
  Description of Artificial Sequence: Synthetic oligonucleotide
ttttaattttatatttattt

SEQ ID NO: 13159 - DNA, 20 bp, Artificial Sequence
  Description of Artificial Sequence: Synthetic oligonucleotide
tttaattttatatttatttt

SEQ ID NO: 13160 - DNA, 20 bp, Artificial Sequence
  Description of Artificial Sequence: Synthetic oligonucleotide
ttaattttatatttatttta

SEQ ID NO: 13161 - DNA, 20 bp, Artificial Sequence
  Description of Artificial Sequence: Synthetic oligonucleotide
taattttatatttattttat

SEQ ID NO: 13162 - DNA, 20 bp, Artificial Sequence
  Description of Artificial Sequence: Synthetic oligonucleotide
aattttatatttattttatt

SEQ ID NO: 13163 - DNA, 20 bp, Artificial Sequence
  Description of Artificial Sequence: Synthetic oligonucleotide
attttatatttattttattt

SEQ ID NO: 13164 - DNA, 20 bp, Artificial Sequence
  Description of Artificial Sequence: Synthetic oligonucleotide
ttttatatttattttatttt

SEQ ID NO: 13165 - DNA, 20 bp, Artificial Sequence
  Description of Artificial Sequence: Synthetic oligonucleotide
tttatatttattttatttta

SEQ ID NO: 13166 - DNA, 20 bp, Artificial Sequence
  Description of Artificial Sequence: Synthetic oligonucleotide
ttatatttattttattttat

SEQ ID NO: 13167 - DNA, 20 bp, Artificial Sequence
  Description of Artificial Sequence: Synthetic oligonucleotide
tatatttattttattttatt

SEQ ID NO: 13168 - DNA, 20 bp, Artificial Sequence
  Description of Artificial Sequence: Synthetic oligonucleotide
atatttattttattttattt

SEQ ID NO: 13169 - DNA, 20 bp, Artificial Sequence
  Description of Artificial Sequence: Synthetic oligonucleotide
tatttattttattttatttt

SEQ ID NO: 13170 - DNA, 20 bp, Artificial Sequence
  Description of Artificial Sequence: Synthetic oligonucleotide
atttattttattttatttta

SEQ ID NO: 13171 - DNA, 20 bp, Artificial Sequence
  Description of Artificial Sequence: Synthetic oligonucleotide
tttattttattttattttat

SEQ ID NO: 13172 - DNA, 20 bp, Artificial Sequence
  Description of Artificial Sequence: Synthetic oligonucleotide
ttattttattttattttatt

SEQ ID NO: 13173 - DNA, 20 bp, Artificial Sequence
  Description of Artificial Sequence: Synthetic oligonucleotide
tattttattttattttattt

SEQ ID NO: 13174 - DNA, 20 bp, Artificial Sequence
  Description of Artificial Sequence: Synthetic oligonucleotide
attttattttattttattta

SEQ ID NO: 13175 - DNA, 20 bp, Artificial Sequence
  Description of Artificial Sequence: Synthetic oligonucleotide
ttttattttattttatttat

SEQ ID NO: 13176 - DNA, 20 bp, Artificial Sequence
  Description of Artificial Sequence: Synthetic oligonucleotide
tttattttattttatttatt

SEQ ID NO: 13177 - DNA, 20 bp, Artificial Sequence
  Description of Artificial Sequence: Synthetic oligonucleotide
ttattttattttatttattt

SEQ ID NO: 13178 - DNA, 20 bp, Artificial Sequence
  Description of Artificial Sequence: Synthetic oligonucleotide
tattttattttatttatttt

SEQ ID NO: 13179 - DNA, 20 bp, Artificial Sequence
  Description of Artificial Sequence: Synthetic oligonucleotide
attttattttatttattttg

SEQ ID NO: 13180 - DNA, 20 bp, Artificial Sequence
  Description of Artificial Sequence: Synthetic oligonucleotide
ttttattttatttattttgt

SEQ ID NO: 13181 - DNA, 20 bp, Artificial Sequence
  Description of Artificial Sequence: Synthetic oligonucleotide
tttattttatttattttgtg

SEQ ID NO: 13182 - DNA, 20 bp, Artificial Sequence
  Description of Artificial Sequence: Synthetic oligonucleotide
ttattttatttattttgtgt

SEQ ID NO: 13183 - DNA, 20 bp, Artificial Sequence
  Description of Artificial Sequence: Synthetic oligonucleotide
tattttatttattttgtgtg

SEQ ID NO: 13184 - DNA, 20 bp, Artificial Sequence
  Description of Artificial Sequence: Synthetic oligonucleotide
attttatttattttgtgtgt

SEQ ID NO: 13185 - DNA, 20 bp, Artificial Sequence
  Description of Artificial Sequence: Synthetic oligonucleotide
ttttatttattttgtgtgtg

SEQ ID NO: 13186 - DNA, 20 bp, Artificial Sequence
  Description of Artificial Sequence: Synthetic oligonucleotide
tttatttattttgtgtgtgt

SEQ ID NO: 13187 - DNA, 20 bp, Artificial Sequence
  Description of Artificial Sequence: Synthetic oligonucleotide
ttatttattttgtgtgtgtg

SEQ ID NO: 13188 - DNA, 20 bp, Artificial Sequence
  Description of Artificial Sequence: Synthetic oligonucleotide
tatttattttgtgtgtgtgt

SEQ ID NO: 13189 - DNA, 20 bp, Artificial Sequence
  Description of Artificial Sequence: Synthetic oligonucleotide
atttattttgtgtgtgtgtg

SEQ ID NO: 13190 - DNA, 20 bp, Artificial Sequence
  Description of Artificial Sequence: Synthetic oligonucleotide
tttattttgtgtgtgtgtgt

SEQ ID NO: 13191 - DNA, 20 bp, Artificial Sequence
  Description of Artificial Sequence: Synthetic oligonucleotide
ttattttgtgtgtgtgtgtg

SEQ ID NO: 13192 - DNA, 20 bp, Artificial Sequence
  Description of Artificial Sequence: Synthetic oligonucleotide
tattttgtgtgtgtgtgtgt

SEQ ID NO: 13193 - DNA, 20 bp, Artificial Sequence
  Description of Artificial Sequence: Synthetic oligonucleotide
attttgtgtgtgtgtgtgtg

SEQ ID NO: 13194 - DNA, 20 bp, Artificial Sequence
  Description of Artificial Sequence: Synthetic oligonucleotide
ttttgtgtgtgtgtgtgtgt

SEQ ID NO: 13195 - DNA, 20 bp, Artificial Sequence
  Description of Artificial Sequence: Synthetic oligonucleotide
tttgtgtgtgtgtgtgtgtg

SEQ ID NO: 13196 - DNA, 20 bp, Artificial Sequence
  Description of Artificial Sequence: Synthetic oligonucleotide
ttgtgtgtgtgtgtgtgtgt

SEQ ID NO: 13197 - DNA, 20 bp, Artificial Sequence
  Description of Artificial Sequence: Synthetic oligonucleotide
tgtgtgtgtgtgtgtgtgtg

SEQ ID NO: 13198 - DNA, 20 bp, Artificial Sequence
  Description of Artificial Sequence: Synthetic oligonucleotide
gtgtgtgtgtgtgtgtgtgt

SEQ ID NO: 13199 - DNA, 20 bp, Artificial Sequence
  Description of Artificial Sequence: Synthetic oligonucleotide
tgtgtgtgtgtgtgtgtgtg

SEQ ID NO: 13200 - DNA, 20 bp, Artificial Sequence
  Description of Artificial Sequence: Synthetic oligonucleotide
gtgtgtgtgtgtgtgtgtgt

SEQ ID NO: 13201 - DNA, 20 bp, Artificial Sequence
  Description of Artificial Sequence: Synthetic oligonucleotide
tgtgtgtgtgtgtgtgtgta

SEQ ID NO: 13202 - DNA, 20 bp, Artificial Sequence
  Description of Artificial Sequence: Synthetic oligonucleotide
gtgtgtgtgtgtgtgtgtag

SEQ ID NO: 13203 - DNA, 20 bp, Artificial Sequence
  Description of Artificial Sequence: Synthetic oligonucleotide
tgtgtgtgtgtgtgtgtaga

SEQ ID NO: 13204 - DNA, 20 bp, Artificial Sequence
  Description of Artificial Sequence: Synthetic oligonucleotide
gtgtgtgtgtgtgtgtagaa

SEQ ID NO: 13205 - DNA, 20 bp, Artificial Sequence
  Description of Artificial Sequence: Synthetic oligonucleotide
tgtgtgtgtgtgtgtagaag

SEQ ID NO: 13206 - DNA, 20 bp, Artificial Sequence
  Description of Artificial Sequence: Synthetic oligonucleotide
gtgtgtgtgtgtgtagaaga

SEQ ID NO: 13207 - DNA, 20 bp, Artificial Sequence
  Description of Artificial Sequence: Synthetic oligonucleotide
tgtgtgtgtgtgtagaagag

SEQ ID NO: 13208 - DNA, 20 bp, Artificial Sequence
  Description of Artificial Sequence: Synthetic oligonucleotide
gtgtgtgtgtgtagaagaga

SEQ ID NO: 13209 - DNA, 20 bp, Artificial Sequence
  Description of Artificial Sequence: Synthetic oligonucleotide
tgtgtgtgtgtagaagagac

SEQ ID NO: 13210 - DNA, 20 bp, Artificial Sequence
  Description of Artificial Sequence: Synthetic oligonucleotide
gtgtgtgtgtagaagagacg

SEQ ID NO: 13211 - DNA, 20 bp, Artificial Sequence
  Description of Artificial Sequence: Synthetic oligonucleotide
tgtgtgtgtagaagagacgg

SEQ ID NO: 13212 - DNA, 20 bp, Artificial Sequence
  Description of Artificial Sequence: Synthetic oligonucleotide
gtgtgtgtagaagagacggg

SEQ ID NO: 13213 - DNA, 20 bp, Artificial Sequence
  Description of Artificial Sequence: Synthetic oligonucleotide
tgtgtgtagaagagacgggg

SEQ ID NO: 13214 - DNA, 20 bp, Artificial Sequence
  Description of Artificial Sequence: Synthetic oligonucleotide
gtgtgtagaagagacggggg

SEQ ID NO: 13215 - DNA, 20 bp, Artificial Sequence
  Description of Artificial Sequence: Synthetic oligonucleotide
tgtgtagaagagacgggggt

SEQ ID NO: 13216 - DNA, 20 bp, Artificial Sequence
  Description of Artificial Sequence: Synthetic oligonucleotide
gtgtagaagagacgggggtc

SEQ ID NO: 13217 - DNA, 20 bp, Artificial Sequence
  Description of Artificial Sequence: Synthetic oligonucleotide
tgtagaagagacgggggtct

SEQ ID NO: 13218 - DNA, 20 bp, Artificial Sequence
  Description of Artificial Sequence: Synthetic oligonucleotide
gtagaagagacgggggtctc

SEQ ID NO: 13219 - DNA, 20 bp, Artificial Sequence
  Description of Artificial Sequence: Synthetic oligonucleotide
tagaagagacgggggtctcg

SEQ ID NO: 13220 - DNA, 20 bp, Artificial Sequence
  Description of Artificial Sequence: Synthetic oligonucleotide
agaagagacgggggtctcgc

SEQ ID NO: 13221 - DNA, 20 bp, Artificial Sequence
  Description of Artificial Sequence: Synthetic oligonucleotide
gaagagacgggggtctcgct

SEQ ID NO: 13222 - DNA, 20 bp, Artificial Sequence
  Description of Artificial Sequence: Synthetic oligonucleotide
aagagacgggggtctcgcta

SEQ ID NO: 13223 - DNA, 20 bp, Artificial Sequence
  Description of Artificial Sequence: Synthetic oligonucleotide
agagacgggggtctcgctat

SEQ ID NO: 13224 - DNA, 20 bp, Artificial Sequence
  Description of Artificial Sequence: Synthetic oligonucleotide
gagacgggggtctcgctatt

SEQ ID NO: 13225 - DNA, 20 bp, Artificial Sequence
  Description of Artificial Sequence: Synthetic oligonucleotide
agacgggggtctcgctattt

SEQ ID NO: 13226 - DNA, 20 bp, Artificial Sequence
  Description of Artificial Sequence: Synthetic oligonucleotide
gacgggggtctcgctatttt

SEQ ID NO: 13227 - DNA, 20 bp, Artificial Sequence
  Description of Artificial Sequence: Synthetic oligonucleotide
acgggggtctcgctattttg

SEQ ID NO: 13228 - DNA, 20 bp, Artificial Sequence
  Description of Artificial Sequence: Synthetic oligonucleotide
cgggggtctcgctattttgc

SEQ ID NO: 13229 - DNA, 20 bp, Artificial Sequence
  Description of Artificial Sequence: Synthetic oligonucleotide
gggggtctcgctattttgct

SEQ ID NO: 13230 - DNA, 20 bp, Artificial Sequence
  Description of Artificial Sequence: Synthetic oligonucleotide
ggggtctcgctattttgctt

SEQ ID NO: 13231 - DNA, 20 bp, Artificial Sequence
  Description of Artificial Sequence: Synthetic oligonucleotide
gggtctcgctattttgcttt

SEQ ID NO: 13232 - DNA, 20 bp, Artificial Sequence
  Description of Artificial Sequence: Synthetic oligonucleotide
ggtctcgctattttgcttta

SEQ ID NO: 13233 - DNA, 20 bp, Artificial Sequence
  Description of Artificial Sequence: Synthetic oligonucleotide
gtctcgctattttgctttag

SEQ ID NO: 13234 - DNA, 20 bp, Artificial Sequence
  Description of Artificial Sequence: Synthetic oligonucleotide
tctcgctattttgctttagg

SEQ ID NO: 13235 - DNA, 20 bp, Artificial Sequence
  Description of Artificial Sequence: Synthetic oligonucleotide
ctcgctattttgctttaggt

SEQ ID NO: 13236 - DNA, 20 bp, Artificial Sequence
  Description of Artificial Sequence: Synthetic oligonucleotide
tcgctattttgctttaggtg

SEQ ID NO: 13237 - DNA, 20 bp, Artificial Sequence
  Description of Artificial Sequence: Synthetic oligonucleotide
cgctattttgctttaggtgg

SEQ ID NO: 13238 - DNA, 20 bp, Artificial Sequence
  Description of Artificial Sequence: Synthetic oligonucleotide
gctattttgctttaggtggt

SEQ ID NO: 13239 - DNA, 20 bp, Artificial Sequence
  Description of Artificial Sequence: Synthetic oligonucleotide
ctattttgctttaggtggtc

SEQ ID NO: 13240 - DNA, 20 bp, Artificial Sequence
  Description of Artificial Sequence: Synthetic oligonucleotide
tattttgctttaggtggtct

SEQ ID NO: 13241 - DNA, 20 bp, Artificial Sequence
  Description of Artificial Sequence: Synthetic oligonucleotide
attttgctttaggtggtctt

SEQ ID NO: 13242 - DNA, 20 bp, Artificial Sequence
  Description of Artificial Sequence: Synthetic oligonucleotide
ttttgctttaggtggtcttg

SEQ ID NO: 13243 - DNA, 20 bp, Artificial Sequence
  Description of Artificial Sequence: Synthetic oligonucleotide
tttgctttaggtggtcttga

SEQ ID NO: 13244 - DNA, 20 bp, Artificial Sequence
  Description of Artificial Sequence: Synthetic oligonucleotide
ttgctttaggtggtcttgaa

SEQ ID NO: 13245 - DNA, 20 bp, Artificial Sequence
  Description of Artificial Sequence: Synthetic oligonucleotide
tgctttaggtggtcttgaat

SEQ ID NO: 13246 - DNA, 20 bp, Artificial Sequence
  Description of Artificial Sequence: Synthetic oligonucleotide
gctttaggtggtcttgaatt

SEQ ID NO: 13247 - DNA, 20 bp, Artificial Sequence
  Description of Artificial Sequence: Synthetic oligonucleotide
ctttaggtggtcttgaattc

SEQ ID NO: 13248 - DNA, 20 bp, Artificial Sequence
  Description of Artificial Sequence: Synthetic oligonucleotide
tttaggtggtcttgaattcc

SEQ ID NO: 13249 - DNA, 20 bp, Artificial Sequence
  Description of Artificial Sequence: Synthetic oligonucleotide
ttaggtggtcttgaattcct

SEQ ID NO: 13250 - DNA, 20 bp, Artificial Sequence
  Description of Artificial Sequence: Synthetic oligonucleotide
taggtggtcttgaattcctg

SEQ ID NO: 13251 - DNA, 20 bp, Artificial Sequence
  Description of Artificial Sequence: Synthetic oligonucleotide
aggtggtcttgaattcctgg

SEQ ID NO: 13252 - DNA, 20 bp, Artificial Sequence
  Description of Artificial Sequence: Synthetic oligonucleotide
ggtggtcttgaattcctggc

SEQ ID NO: 13253 - DNA, 20 bp, Artificial Sequence
  Description of Artificial Sequence: Synthetic oligonucleotide
gtggtcttgaattcctggcc

SEQ ID NO: 13254 - DNA, 20 bp, Artificial Sequence
  Description of Artificial Sequence: Synthetic oligonucleotide
tggtcttgaattcctggcct

SEQ ID NO: 13255 - DNA, 20 bp, Artificial Sequence
  Description of Artificial Sequence: Synthetic oligonucleotide
ggtcttgaattcctggcctt

SEQ ID NO: 13256 - DNA, 20 bp, Artificial Sequence
  Description of Artificial Sequence: Synthetic oligonucleotide
gtcttgaattcctggccttg

SEQ ID NO: 13257 - DNA, 20 bp, Artificial Sequence
  Description of Artificial Sequence: Synthetic oligonucleotide
tcttgaattcctggccttga

SEQ ID NO: 13258 - DNA, 20 bp, Artificial Sequence
  Description of Artificial Sequence: Synthetic oligonucleotide
cttgaattcctggccttgag

SEQ ID NO: 13259 - DNA, 20 bp, Artificial Sequence
  Description of Artificial Sequence: Synthetic oligonucleotide
ttgaattcctggccttgagc

SEQ ID NO: 13260 - DNA, 20 bp, Artificial Sequence
  Description of Artificial Sequence: Synthetic oligonucleotide
tgaattcctggccttgagcg

SEQ ID NO: 13261 - DNA, 20 bp, Artificial Sequence
  Description of Artificial Sequence: Synthetic oligonucleotide
gaattcctggccttgagcga

SEQ ID NO: 13262 - DNA, 20 bp, Artificial Sequence
  Description of Artificial Sequence: Synthetic oligonucleotide
aattcctggccttgagcgaa

SEQ ID NO: 13263 - DNA, 20 bp, Artificial Sequence
  Description of Artificial Sequence: Synthetic oligonucleotide
attcctggccttgagcgaac

SEQ ID NO: 13264 - DNA, 20 bp, Artificial Sequence
  Description of Artificial Sequence: Synthetic oligonucleotide
ttcctggccttgagcgaacc

SEQ ID NO: 13265 - DNA, 20 bp, Artificial Sequence
  Description of Artificial Sequence: Synthetic oligonucleotide
tcctggccttgagcgaacct

SEQ ID NO: 13266 - DNA, 20 bp, Artificial Sequence
  Description of Artificial Sequence: Synthetic oligonucleotide
cctggccttgagcgaacctc

SEQ ID NO: 13267 - DNA, 20 bp, Artificial Sequence
  Description of Artificial Sequence: Synthetic oligonucleotide
ctggccttgagcgaacctcc

SEQ ID NO: 13268 - DNA, 20 bp, Artificial Sequence
  Description of Artificial Sequence: Synthetic oligonucleotide
tggccttgagcgaacctccc

SEQ ID NO: 13269 - DNA, 20 bp, Artificial Sequence
  Description of Artificial Sequence: Synthetic oligonucleotide
ggccttgagcgaacctccct

SEQ ID NO: 13270 - DNA, 20 bp, Artificial Sequence
  Description of Artificial Sequence: Synthetic oligonucleotide
gccttgagcgaacctccctc

SEQ ID NO: 13271 - DNA, 20 bp, Artificial Sequence
  Description of Artificial Sequence: Synthetic oligonucleotide
ccttgagcgaacctccctcc

SEQ ID NO: 13272 - DNA, 20 bp, Artificial Sequence
  Description of Artificial Sequence: Synthetic oligonucleotide
cttgagcgaacctccctcct

SEQ ID NO: 13273 - DNA, 20 bp, Artificial Sequence
  Description of Artificial Sequence: Synthetic oligonucleotide
ttgagcgaacctccctcctc

SEQ ID NO: 13274 - DNA, 20 bp, Artificial Sequence
  Description of Artificial Sequence: Synthetic oligonucleotide
tgagcgaacctccctcctcg

SEQ ID NO: 13275 - DNA, 20 bp, Artificial Sequence
  Description of Artificial Sequence: Synthetic oligonucleotide
gagcgaacctccctcctcgg

SEQ ID NO: 13276 - DNA, 20 bp, Artificial Sequence
  Description of Artificial Sequence: Synthetic oligonucleotide
agcgaacctccctcctcggc

SEQ ID NO: 13277 - DNA, 20 bp, Artificial Sequence
  Description of Artificial Sequence: Synthetic oligonucleotide
gcgaacctccctcctcggct

SEQ ID NO: 13278 - DNA, 20 bp, Artificial Sequence
  Description of Artificial Sequence: Synthetic oligonucleotide
cgaacctccctcctcggctt

SEQ ID NO: 13279 - DNA, 20 bp, Artificial Sequence
  Description of Artificial Sequence: Synthetic oligonucleotide
gaacctccctcctcggcttc

SEQ ID NO: 13280 - DNA, 20 bp, Artificial Sequence
  Description of Artificial Sequence: Synthetic oligonucleotide
aacctccctcctcggcttcc

SEQ ID NO: 13281 - DNA, 20 bp, Artificial Sequence
  Description of Artificial Sequence: Synthetic oligonucleotide
acctccctcctcggcttcct

SEQ ID NO: 13282 - DNA, 20 bp, Artificial Sequence
  Description of Artificial Sequence: Synthetic oligonucleotide
cctccctcctcggcttccta

SEQ ID NO: 13283 - DNA, 20 bp, Artificial Sequence
  Description of Artificial Sequence: Synthetic oligonucleotide
ctccctcctcggcttcctaa

SEQ ID NO: 13284 - DNA, 20 bp, Artificial Sequence
  Description of Artificial Sequence: Synthetic oligonucleotide
tccctcctcggcttcctaag

SEQ ID NO: 13285 - DNA, 20 bp, Artificial Sequence
  Description of Artificial Sequence: Synthetic oligonucleotide
ccctcctcggcttcctaagg

SEQ ID NO: 13286 - DNA, 20 bp, Artificial Sequence
  Description of Artificial Sequence: Synthetic oligonucleotide
cctcctcggcttcctaaggg

SEQ ID NO: 13287 - DNA, 20 bp, Artificial Sequence
  Description of Artificial Sequence: Synthetic oligonucleotide
ctcctcggcttcctaagggg

SEQ ID NO: 13288 - DNA, 20 bp, Artificial Sequence
  Description of Artificial Sequence: Synthetic oligonucleotide
tcctcggcttcctaaggggg

SEQ ID NO: 13289 - DNA, 20 bp, Artificial Sequence
  Description of Artificial Sequence: Synthetic oligonucleotide
cctcggcttcctaagggggg

SEQ ID NO: 13290 - DNA, 20 bp, Artificial Sequence
  Description of Artificial Sequence: Synthetic oligonucleotide
ctcggcttcctaagggggga

SEQ ID NO: 13291 - DNA, 20 bp, Artificial Sequence
  Description of Artificial Sequence: Synthetic oligonucleotide
tcggcttcctaaggggggag

SEQ ID NO: 13292 - DNA, 20 bp, Artificial Sequence
  Description of Artificial Sequence: Synthetic oligonucleotide
cggcttcctaaggggggagc

SEQ ID NO: 13293 - DNA, 20 bp, Artificial Sequence
  Description of Artificial Sequence: Synthetic oligonucleotide
ggcttcctaaggggggagcc

SEQ ID NO: 13294 - DNA, 20 bp, Artificial Sequence
  Description of Artificial Sequence: Synthetic oligonucleotide
gcttcctaaggggggagccc

SEQ ID NO: 13295 - DNA, 20 bp, Artificial Sequence
  Description of Artificial Sequence: Synthetic oligonucleotide
cttcctaaggggggagccca

SEQ ID NO: 13296 - DNA, 20 bp, Artificial Sequence
  Description of Artificial Sequence: Synthetic oligonucleotide
ttcctaaggggggagcccat

SEQ ID NO: 13297 - DNA, 20 bp, Artificial Sequence
  Description of Artificial Sequence: Synthetic oligonucleotide
tcctaaggggggagcccatc

SEQ ID NO: 13298 - DNA, 20 bp, Artificial Sequence
  Description of Artificial Sequence: Synthetic oligonucleotide
cctaaggggggagcccatcc

SEQ ID NO: 13299 - DNA, 20 bp, Artificial Sequence
  Description of Artificial Sequence: Synthetic oligonucleotide
ctaaggggggagcccatccc

SEQ ID NO: 13300 - DNA, 20 bp, Artificial Sequence
  Description of Artificial Sequence: Synthetic oligonucleotide
taaggggggagcccatccct

SEQ ID NO: 13301 - DNA, 20 bp, Artificial Sequence
  Description of Artificial Sequence: Synthetic oligonucleotide
aaggggggagcccatccctt

SEQ ID NO: 13302 - DNA, 20 bp, Artificial Sequence
  Description of Artificial Sequence: Synthetic oligonucleotide
aggggggagcccatcccttg

SEQ ID NO: 13303 - DNA, 20 bp, Artificial Sequence
  Description of Artificial Sequence: Synthetic oligonucleotide
ggggggagcccatcccttga

SEQ ID NO: 13304 - DNA, 20 bp, Artificial Sequence
  Description of Artificial Sequence: Synthetic oligonucleotide
gggggagcccatcccttgac

SEQ ID NO: 13305 - DNA, 20 bp, Artificial Sequence
  Description of Artificial Sequence: Synthetic oligonucleotide
ggggagcccatcccttgacg

SEQ ID NO: 13306 - DNA, 20 bp, Artificial Sequence
  Description of Artificial Sequence: Synthetic oligonucleotide
gggagcccatcccttgacgc

SEQ ID NO: 13307 - DNA, 20 bp, Artificial Sequence
  Description of Artificial Sequence: Synthetic oligonucleotide
ggagcccatcccttgacgca

SEQ ID NO: 13308 - DNA, 20 bp, Artificial Sequence
  Description of Artificial Sequence: Synthetic oligonucleotide
gagcccatcccttgacgcag

SEQ ID NO: 13309 - DNA, 20 bp, Artificial Sequence
  Description of Artificial Sequence: Synthetic oligonucleotide
agcccatcccttgacgcagg

SEQ ID NO: 13310 - DNA, 20 bp, Artificial Sequence
  Description of Artificial Sequence: Synthetic oligonucleotide
gcccatcccttgacgcaggg

SEQ ID NO: 13311 - DNA, 20 bp, Artificial Sequence
  Description of Artificial Sequence: Synthetic oligonucleotide
cccatcccttgacgcaggga

SEQ ID NO: 13312 - DNA, 20 bp, Artificial Sequence
  Description of Artificial Sequence: Synthetic oligonucleotide
ccatcccttgacgcagggaa

SEQ ID NO: 13313 - DNA, 20 bp, Artificial Sequence
  Description of Artificial Sequence: Synthetic oligonucleotide
catcccttgacgcagggaag

SEQ ID NO: 13314 - DNA, 20 bp, Artificial Sequence
  Description of Artificial Sequence: Synthetic oligonucleotide
atcccttgacgcagggaagc

SEQ ID NO: 13315 - DNA, 20 bp, Artificial Sequence
  Description of Artificial Sequence: Synthetic oligonucleotide
tcccttgacgcagggaagcc

SEQ ID NO: 13316 - DNA, 20 bp, Artificial Sequence
  Description of Artificial Sequence: Synthetic oligonucleotide
cccttgacgcagggaagccc

SEQ ID NO: 13317 - DNA, 20 bp, Artificial Sequence
  Description of Artificial Sequence: Synthetic oligonucleotide
ccttgacgcagggaagccca

SEQ ID NO: 13318 - DNA, 20 bp, Artificial Sequence
  Description of Artificial Sequence: Synthetic oligonucleotide
cttgacgcagggaagcccag

SEQ ID NO: 13319 - DNA, 20 bp, Artificial Sequence
  Description of Artificial Sequence: Synthetic oligonucleotide
ttgacgcagggaagcccagg

SEQ ID NO: 13320 - DNA, 20 bp, Artificial Sequence
  Description of Artificial Sequence: Synthetic oligonucleotide
tgacgcagggaagcccaggg

SEQ ID NO: 13321 - DNA, 20 bp, Artificial Sequence
  Description of Artificial Sequence: Synthetic oligonucleotide
gacgcagggaagcccaggga

SEQ ID NO: 13322 - DNA, 20 bp, Artificial Sequence
  Description of Artificial Sequence: Synthetic oligonucleotide
acgcagggaagcccagggag

SEQ ID NO: 13323 - DNA, 20 bp, Artificial Sequence
  Description of Artificial Sequence: Synthetic oligonucleotide
cgcagggaagcccagggagc

SEQ ID NO: 13324 - DNA, 20 bp, Artificial Sequence
  Description of Artificial Sequence: Synthetic oligonucleotide
gcagggaagcccagggagcc

SEQ ID NO: 13325 - DNA, 20 bp, Artificial Sequence
  Description of Artificial Sequence: Synthetic oligonucleotide
cagggaagcccagggagcca

SEQ ID NO: 13326 - DNA, 20 bp, Artificial Sequence
  Description of Artificial Sequence: Synthetic oligonucleotide
agggaagcccagggagccac

SEQ ID NO: 13327 - DNA, 20 bp, Artificial Sequence
  Description of Artificial Sequence: Synthetic oligonucleotide
gggaagcccagggagccaca

SEQ ID NO: 13328 - DNA, 20 bp, Artificial Sequence
  Description of Artificial Sequence: Synthetic oligonucleotide
ggaagcccagggagccacag

SEQ ID NO: 13329 - DNA, 20 bp, Artificial Sequence
  Description of Artificial Sequence: Synthetic oligonucleotide
gaagcccagggagccacagt

SEQ ID NO: 13330 - DNA, 20 bp, Artificial Sequence
  Description of Artificial Sequence: Synthetic oligonucleotide
aagcccagggagccacagtt

SEQ ID NO: 13331 - DNA, 20 bp, Artificial Sequence
  Description of Artificial Sequence: Synthetic oligonucleotide
agcccagggagccacagttg

SEQ ID NO: 13332 - DNA, 20 bp, Artificial Sequence
  Description of Artificial Sequence: Synthetic oligonucleotide
gcccagggagccacagttgc

SEQ ID NO: 13333 - DNA, 20 bp, Artificial Sequence
  Description of Artificial Sequence: Synthetic oligonucleotide
cccagggagccacagttgcg

SEQ ID NO: 13334 - DNA, 20 bp, Artificial Sequence
  Description of Artificial Sequence: Synthetic oligonucleotide
ccagggagccacagttgcgc

SEQ ID NO: 13335 - DNA, 20 bp, Artificial Sequence
  Description of Artificial Sequence: Synthetic oligonucleotide
cagggagccacagttgcgca

SEQ ID NO: 13336 - DNA, 20 bp, Artificial Sequence
  Description of Artificial Sequence: Synthetic oligonucleotide
agggagccacagttgcgcac

SEQ ID NO: 13337 - DNA, 20 bp, Artificial Sequence
  Description of Artificial Sequence: Synthetic oligonucleotide
gggagccacagttgcgcacc

SEQ ID NO: 13338 - DNA, 20 bp, Artificial Sequence
  Description of Artificial Sequence: Synthetic oligonucleotide
ggagccacagttgcgcaccc

SEQ ID NO: 13339 - DNA, 20 bp, Artificial Sequence
  Description of Artificial Sequence: Synthetic oligonucleotide
gagccacagttgcgcacccc

SEQ ID NO: 13340 - DNA, 20 bp, Artificial Sequence
  Description of Artificial Sequence: Synthetic oligonucleotide
agccacagttgcgcaccccg

SEQ ID NO: 13341 - DNA, 20 bp, Artificial Sequence
  Description of Artificial Sequence: Synthetic oligonucleotide
gccacagttgcgcaccccgc

SEQ ID NO: 13342 - DNA, 20 bp, Artificial Sequence
  Description of Artificial Sequence: Synthetic oligonucleotide
ccacagttgcgcaccccgcc

SEQ ID NO: 13343 - DNA, 20 bp, Artificial Sequence
  Description of Artificial Sequence: Synthetic oligonucleotide
cacagttgcgcaccccgccc

SEQ ID NO: 13344 - DNA, 20 bp, Artificial Sequence
  Description of Artificial Sequence: Synthetic oligonucleotide
acagttgcgcaccccgcccc

SEQ ID NO: 13345 - DNA, 20 bp, Artificial Sequence
  Description of Artificial Sequence: Synthetic oligonucleotide
cagttgcgcaccccgccccc

SEQ ID NO: 13346 - DNA, 20 bp, Artificial Sequence
  Description of Artificial Sequence: Synthetic oligonucleotide
agttgcgcaccccgccccca

SEQ ID NO: 13347 - DNA, 20 bp, Artificial Sequence
  Description of Artificial Sequence: Synthetic oligonucleotide
gttgcgcaccccgcccccac

SEQ ID NO: 13348 - DNA, 20 bp, Artificial Sequence
  Description of Artificial Sequence: Synthetic oligonucleotide
ttgcgcaccccgcccccacg

SEQ ID NO: 13349 - DNA, 20 bp, Artificial Sequence
  Description of Artificial Sequence: Synthetic oligonucleotide
tgcgcaccccgcccccacgc

SEQ ID NO: 13350 - DNA, 20 bp, Artificial Sequence
  Description of Artificial Sequence: Synthetic oligonucleotide
gcgcaccccgcccccacgcc

SEQ ID NO: 13351 - DNA, 20 bp, Artificial Sequence
  Description of Artificial Sequence: Synthetic oligonucleotide
cgcaccccgcccccacgccc

SEQ ID NO: 13352 - DNA, 20 bp, Artificial Sequence
  Description of Artificial Sequence: Synthetic oligonucleotide
gcaccccgcccccacgcccc

SEQ ID NO: 13353 - DNA, 20 bp, Artificial Sequence
  Description of Artificial Sequence: Synthetic oligonucleotide
caccccgcccccacgcccca

SEQ ID NO: 13354 - DNA, 20 bp, Artificial Sequence
  Description of Artificial Sequence: Synthetic oligonucleotide
accccgcccccacgccccac

SEQ ID NO: 13355 - DNA, 20 bp, Artificial Sequence
  Description of Artificial Sequence: Synthetic oligonucleotide
ccccgcccccacgccccact

SEQ ID NO: 13356 - DNA, 20 bp, Artificial Sequence
  Description of Artificial Sequence: Synthetic oligonucleotide
cccgcccccacgccccactc

SEQ ID NO: 13357 - DNA, 20 bp, Artificial Sequence
  Description of Artificial Sequence: Synthetic oligonucleotide
ccgcccccacgccccactcc

SEQ ID NO: 13358 - DNA, 20 bp, Artificial Sequence
  Description of Artificial Sequence: Synthetic oligonucleotide
cgcccccacgccccactcct

SEQ ID NO: 13359 - DNA, 20 bp, Artificial Sequence
  Description of Artificial Sequence: Synthetic oligonucleotide
gcccccacgccccactcctg

SEQ ID NO: 13360 - DNA, 20 bp, Artificial Sequence
  Description of Artificial Sequence: Synthetic oligonucleotide
cccccacgccccactcctgt

SEQ ID NO: 13361 - DNA, 20 bp, Artificial Sequence
  Description of Artificial Sequence: Synthetic oligonucleotide
ccccacgccccactcctgtc

SEQ ID NO: 13362 - DNA, 20 bp, Artificial Sequence
  Description of Artificial Sequence: Synthetic oligonucleotide
cccacgccccactcctgtcc

SEQ ID NO: 13363 - DNA, 20 bp, Artificial Sequence
  Description of Artificial Sequence: Synthetic oligonucleotide
ccacgccccactcctgtcca

SEQ ID NO: 13364 - DNA, 20 bp, Artificial Sequence
  Description of Artificial Sequence: Synthetic oligonucleotide
cacgccccactcctgtccat

SEQ ID NO: 13365 - DNA, 20 bp, Artificial Sequence
  Description of Artificial Sequence: Synthetic oligonucleotide
acgccccactcctgtccata

SEQ ID NO: 13366 - DNA, 20 bp, Artificial Sequence
  Description of Artificial Sequence: Synthetic oligonucleotide
cgccccactcctgtccatac

SEQ ID NO: 13367 - DNA, 20 bp, Artificial Sequence
  Description of Artificial Sequence: Synthetic oligonucleotide
gccccactcctgtccatacc

SEQ ID NO: 13368 - DNA, 20 bp, Artificial Sequence
  Description of Artificial Sequence: Synthetic oligonucleotide
ccccactcctgtccataccc

SEQ ID NO: 13369 - DNA, 20 bp, Artificial Sequence
  Description of Artificial Sequence: Synthetic oligonucleotide
cccactcctgtccataccct

SEQ ID NO: 13370 - DNA, 20 bp, Artificial Sequence
  Description of Artificial Sequence: Synthetic oligonucleotide
ccactcctgtccataccctt

SEQ ID NO: 13371 - DNA, 20 bp, Artificial Sequence
  Description of Artificial Sequence: Synthetic oligonucleotide
cactcctgtccatacccttc

SEQ ID NO: 13372 - DNA, 20 bp, Artificial Sequence
  Description of Artificial Sequence: Synthetic oligonucleotide
actcctgtccatacccttcc

SEQ ID NO: 13373 - DNA, 20 bp, Artificial Sequence
  Description of Artificial Sequence: Synthetic oligonucleotide
ctcctgtccatacccttcca

SEQ ID NO: 13374 - DNA, 20 bp, Artificial Sequence
  Description of Artificial Sequence: Synthetic oligonucleotide
tcctgtccatacccttccaa

SEQ ID NO: 13375 - DNA, 20 bp, Artificial Sequence
  Description of Artificial Sequence: Synthetic oligonucleotide
cctgtccatacccttccaag

SEQ ID NO: 13376 - DNA, 20 bp, Artificial Sequence
  Description of Artificial Sequence: Synthetic oligonucleotide
ctgtccatacccttccaagc

SEQ ID NO: 13377 - DNA, 20 bp, Artificial Sequence
  Description of Artificial Sequence: Synthetic oligonucleotide
tgtccatacccttccaagcc

SEQ ID NO: 13378 - DNA, 20 bp, Artificial Sequence
  Description of Artificial Sequence: Synthetic oligonucleotide
gtccatacccttccaagcca

SEQ ID NO: 13379 - DNA, 20 bp, Artificial Sequence
  Description of Artificial Sequence: Synthetic oligonucleotide
tccatacccttccaagccag

SEQ ID NO: 13380 - DNA, 20 bp, Artificial Sequence
  Description of Artificial Sequence: Synthetic oligonucleotide
ccatacccttccaagccagg

SEQ ID NO: 13381 - DNA, 20 bp, Artificial Sequence
  Description of Artificial Sequence: Synthetic oligonucleotide
catacccttccaagccagga

SEQ ID NO: 13382 - DNA, 20 bp, Artificial Sequence
  Description of Artificial Sequence: Synthetic oligonucleotide
atacccttccaagccaggag

SEQ ID NO: 13383 - DNA, 20 bp, Artificial Sequence
  Description of Artificial Sequence: Synthetic oligonucleotide
tacccttccaagccaggaga

SEQ ID NO: 13384 - DNA, 20 bp, Artificial Sequence
  Description of Artificial Sequence: Synthetic oligonucleotide
acccttccaagccaggagag

SEQ ID NO: 13385 - DNA, 20 bp, Artificial Sequence
  Description of Artificial Sequence: Synthetic oligonucleotide
cccttccaagccaggagagc

SEQ ID NO: 13386 - DNA, 20 bp, Artificial Sequence
  Description of Artificial Sequence: Synthetic oligonucleotide
ccttccaagccaggagagcc

SEQ ID NO: 13387 - DNA, 20 bp, Artificial Sequence
  Description of Artificial Sequence: Synthetic oligonucleotide
cttccaagccaggagagcca

SEQ ID NO: 13388 - DNA, 20 bp, Artificial Sequence
  Description of Artificial Sequence: Synthetic oligonucleotide
ttccaagccaggagagccac

SEQ ID NO: 13389 - DNA, 20 bp, Artificial Sequence
  Description of Artificial Sequence: Synthetic oligonucleotide
tccaagccaggagagccact

SEQ ID NO: 13390 - DNA, 20 bp, Artificial Sequence
  Description of Artificial Sequence: Synthetic oligonucleotide
ccaagccaggagagccacta

SEQ ID NO: 13391 - DNA, 20 bp, Artificial Sequence
  Description of Artificial Sequence: Synthetic oligonucleotide
caagccaggagagccactag

SEQ ID NO: 13392 - DNA, 20 bp, Artificial Sequence
  Description of Artificial Sequence: Synthetic oligonucleotide
aagccaggagagccactagg

SEQ ID NO: 13393 - DNA, 20 bp, Artificial Sequence
  Description of Artificial Sequence: Synthetic oligonucleotide
agccaggagagccactaggg

SEQ ID NO: 13394 - DNA, 20 bp, Artificial Sequence
  Description of Artificial Sequence: Synthetic oligonucleotide
gccaggagagccactagggg

SEQ ID NO: 13395 - DNA, 20 bp, Artificial Sequence
  Description of Artificial Sequence: Synthetic oligonucleotide
ccaggagagccactaggggc

SEQ ID NO: 13396 - DNA, 20 bp, Artificial Sequence
  Description of Artificial Sequence: Synthetic oligonucleotide
caggagagccactaggggcg

SEQ ID NO: 13397 - DNA, 20 bp, Artificial Sequence
  Description of Artificial Sequence: Synthetic oligonucleotide
aggagagccactaggggcgc

SEQ ID NO: 13398 - DNA, 20 bp, Artificial Sequence
  Description of Artificial Sequence: Synthetic oligonucleotide
ggagagccactaggggcgcg

SEQ ID NO: 13399 - DNA, 20 bp, Artificial Sequence
  Description of Artificial Sequence: Synthetic oligonucleotide
gagagccactaggggcgcgg

SEQ ID NO: 13400 - DNA, 20 bp, Artificial Sequence
  Description of Artificial Sequence: Synthetic oligonucleotide
agagccactaggggcgcgga

SEQ ID NO: 13401 - DNA, 20 bp, Artificial Sequence
  Description of Artificial Sequence: Synthetic oligonucleotide
gagccactaggggcgcggag

SEQ ID NO: 13402 - DNA, 20 bp, Artificial Sequence
  Description of Artificial Sequence: Synthetic oligonucleotide
agccactaggggcgcggaga

SEQ ID NO: 13403 - DNA, 20 bp, Artificial Sequence
  Description of Artificial Sequence: Synthetic oligonucleotide
gccactaggggcgcggagaa

SEQ ID NO: 13404 - DNA, 20 bp, Artificial Sequence
  Description of Artificial Sequence: Synthetic oligonucleotide
ccactaggggcgcggagaac

SEQ ID NO: 13405 - DNA, 20 bp, Artificial Sequence
  Description of Artificial Sequence: Synthetic oligonucleotide
cactaggggcgcggagaacc

SEQ ID NO: 13406 - DNA, 20 bp, Artificial Sequence
  Description of Artificial Sequence: Synthetic oligonucleotide
actaggggcgcggagaacca

SEQ ID NO: 13407 - DNA, 20 bp, Artificial Sequence
  Description of Artificial Sequence: Synthetic oligonucleotide
ctaggggcgcggagaaccag

SEQ ID NO: 13408 - DNA, 20 bp, Artificial Sequence
  Description of Artificial Sequence: Synthetic oligonucleotide
taggggcgcggagaaccagc

SEQ ID NO: 13409 - DNA, 20 bp, Artificial Sequence
  Description of Artificial Sequence: Synthetic oligonucleotide
aggggcgcggagaaccagcc

SEQ ID NO: 13410 - DNA, 20 bp, Artificial Sequence
  Description of Artificial Sequence: Synthetic oligonucleotide
ggggcgcggagaaccagccc

SEQ ID NO: 13411 - DNA, 20 bp, Artificial Sequence
  Description of Artificial Sequence: Synthetic oligonucleotide
gggcgcggagaaccagccct

SEQ ID NO: 13412 - DNA, 20 bp, Artificial Sequence
  Description of Artificial Sequence: Synthetic oligonucleotide
ggcgcggagaaccagccctg

SEQ ID NO: 13413 - DNA, 20 bp, Artificial Sequence
  Description of Artificial Sequence: Synthetic oligonucleotide
gcgcggagaaccagccctgg

SEQ ID NO: 13414 - DNA, 20 bp, Artificial Sequence
  Description of Artificial Sequence: Synthetic oligonucleotide
cgcggagaaccagccctggg

SEQ ID NO: 13415 - DNA, 20 bp, Artificial Sequence
  Description of Artificial Sequence: Synthetic oligonucleotide
gcggagaaccagccctgggg

SEQ ID NO: 13416 - DNA, 20 bp, Artificial Sequence
  Description of Artificial Sequence: Synthetic oligonucleotide
cggagaaccagccctgggga

SEQ ID NO: 13417 - DNA, 20 bp, Artificial Sequence
  Description of Artificial Sequence: Synthetic oligonucleotide
ggagaaccagccctggggac

SEQ ID NO: 13418 - DNA, 20 bp, Artificial Sequence
  Description of Artificial Sequence: Synthetic oligonucleotide
gagaaccagccctggggaca

SEQ ID NO: 13419 - DNA, 20 bp, Artificial Sequence
  Description of Artificial Sequence: Synthetic oligonucleotide
agaaccagccctggggacac

SEQ ID NO: 13420 - DNA, 20 bp, Artificial Sequence
  Description of Artificial Sequence: Synthetic oligonucleotide
gaaccagccctggggacacg

SEQ ID NO: 13421 - DNA, 20 bp, Artificial Sequence
  Description of Artificial Sequence: Synthetic oligonucleotide
aaccagccctggggacacgt

SEQ ID NO: 13422 - DNA, 20 bp, Artificial Sequence
  Description of Artificial Sequence: Synthetic oligonucleotide
accagccctggggacacgta

SEQ ID NO: 13423 - DNA, 20 bp, Artificial Sequence
  Description of Artificial Sequence: Synthetic oligonucleotide
ccagccctggggacacgtac

SEQ ID NO: 13424 - DNA, 20 bp, Artificial Sequence
  Description of Artificial Sequence: Synthetic oligonucleotide
cagccctggggacacgtacc

SEQ ID NO: 13425 - DNA, 20 bp, Artificial Sequence
  Description of Artificial Sequence: Synthetic oligonucleotide
agccctggggacacgtacct

SEQ ID NO: 13426 - DNA, 20 bp, Artificial Sequence
  Description of Artificial Sequence: Synthetic oligonucleotide
gccctggggacacgtacctg

SEQ ID NO: 13427 - DNA, 20 bp, Artificial Sequence
  Description of Artificial Sequence: Synthetic oligonucleotide
ccctggggacacgtacctgc

SEQ ID NO: 13428 - DNA, 20 bp, Artificial Sequence
  Description of Artificial Sequence: Synthetic oligonucleotide
cctggggacacgtacctgca

SEQ ID NO: 13429 - DNA, 20 bp, Artificial Sequence
  Description of Artificial Sequence: Synthetic oligonucleotide
ctggggacacgtacctgcag

SEQ ID NO: 13430 - DNA, 20 bp, Artificial Sequence
  Description of Artificial Sequence: Synthetic oligonucleotide
tggggacacgtacctgcagg

SEQ ID NO: 13431 - DNA, 20 bp, Artificial Sequence
  Description of Artificial Sequence: Synthetic oligonucleotide
ggggacacgtacctgcaggc

SEQ ID NO: 13432 - DNA, 20 bp, Artificial Sequence
  Description of Artificial Sequence: Synthetic oligonucleotide
gggacacgtacctgcaggct

SEQ ID NO: 13433 - DNA, 20 bp, Artificial Sequence
  Description of Artificial Sequence: Synthetic oligonucleotide
ggacacgtacctgcaggctg

SEQ ID NO: 13434 - DNA, 20 bp, Artificial Sequence
  Description of Artificial Sequence: Synthetic oligonucleotide
gacacgtacctgcaggctgt

SEQ ID NO: 13435 - DNA, 20 bp, Artificial Sequence
  Description of Artificial Sequence: Synthetic oligonucleotide
acacgtacctgcaggctgtg

SEQ ID NO: 13436 - DNA, 20 bp, Artificial Sequence
  Description of Artificial Sequence: Synthetic oligonucleotide
cacgtacctgcaggctgtga

SEQ ID NO: 13437 - DNA, 20 bp, Artificial Sequence
  Description of Artificial Sequence: Synthetic oligonucleotide
acgtacctgcaggctgtgaa

SEQ ID NO: 13438 - DNA, 20 bp, Artificial Sequence
  Description of Artificial Sequence: Synthetic oligonucleotide
cgtacctgcaggctgtgaag

SEQ ID NO: 13439 - DNA, 20 bp, Artificial Sequence
  Description of Artificial Sequence: Synthetic oligonucleotide
gtacctgcaggctgtgaagg

SEQ ID NO: 13440 - DNA, 20 bp, Artificial Sequence
  Description of Artificial Sequence: Synthetic oligonucleotide
tacctgcaggctgtgaagga

SEQ ID NO: 13441 - DNA, 20 bp, Artificial Sequence
  Description of Artificial Sequence: Synthetic oligonucleotide
acctgcaggctgtgaaggac

SEQ ID NO: 13442 - DNA, 20 bp, Artificial Sequence
  Description of Artificial Sequence: Synthetic oligonucleotide
cctgcaggctgtgaaggacc

SEQ ID NO: 13443 - DNA, 20 bp, Artificial Sequence
  Description of Artificial Sequence: Synthetic oligonucleotide
ctgcaggctgtgaaggacct

SEQ ID NO: 13444 - DNA, 20 bp, Artificial Sequence
  Description of Artificial Sequence: Synthetic oligonucleotide
tgcaggctgtgaaggacctc

SEQ ID NO: 13445 - DNA, 20 bp, Artificial Sequence
  Description of Artificial Sequence: Synthetic oligonucleotide
gcaggctgtgaaggacctca

SEQ ID NO: 13446 - DNA, 20 bp, Artificial Sequence
  Description of Artificial Sequence: Synthetic oligonucleotide
caggctgtgaaggacctcag

SEQ ID NO: 13447 - DNA, 20 bp, Artificial Sequence
  Description of Artificial Sequence: Synthetic oligonucleotide
aggctgtgaaggacctcagg

SEQ ID NO: 13448 - DNA, 20 bp, Artificial Sequence
  Description of Artificial Sequence: Synthetic oligonucleotide
ggctgtgaaggacctcaggg

SEQ ID NO: 13449 - DNA, 20 bp, Artificial Sequence
  Description of Artificial Sequence: Synthetic oligonucleotide
gctgtgaaggacctcagggt

SEQ ID NO: 13450 - DNA, 20 bp, Artificial Sequence
  Description of Artificial Sequence: Synthetic oligonucleotide
ctgtgaaggacctcagggtc

SEQ ID NO: 13451 - DNA, 20 bp, Artificial Sequence
  Description of Artificial Sequence: Synthetic oligonucleotide
tgtgaaggacctcagggtcc

SEQ ID NO: 13452 - DNA, 20 bp, Artificial Sequence
  Description of Artificial Sequence: Synthetic oligonucleotide
gtgaaggacctcagggtcca

SEQ ID NO: 13453 - DNA, 20 bp, Artificial Sequence
  Description of Artificial Sequence: Synthetic oligonucleotide
tgaaggacctcagggtccac

SEQ ID NO: 13454 - DNA, 20 bp, Artificial Sequence
  Description of Artificial Sequence: Synthetic oligonucleotide
gaaggacctcagggtccacc

SEQ ID NO: 13455 - DNA, 20 bp, Artificial Sequence
  Description of Artificial Sequence: Synthetic oligonucleotide
aaggacctcagggtccaccc

SEQ ID NO: 13456 - DNA, 20 bp, Artificial Sequence
  Description of Artificial Sequence: Synthetic oligonucleotide
aggacctcagggtccacccg

SEQ ID NO: 13457 - DNA, 20 bp, Artificial Sequence
  Description of Artificial Sequence: Synthetic oligonucleotide
ggacctcagggtccacccgg

SEQ ID NO: 13458 - DNA, 20 bp, Artificial Sequence
  Description of Artificial Sequence: Synthetic oligonucleotide
gacctcagggtccacccggc

SEQ ID NO: 13459 - DNA, 20 bp, Artificial Sequence
  Description of Artificial Sequence: Synthetic oligonucleotide
acctcagggtccacccggct

SEQ ID NO: 13460 - DNA, 20 bp, Artificial Sequence
  Description of Artificial Sequence: Synthetic oligonucleotide
cctcagggtccacccggctc

SEQ ID NO: 13461 - DNA, 20 bp, Artificial Sequence
  Description of Artificial Sequence: Synthetic oligonucleotide
ctcagggtccacccggctct

SEQ ID NO: 13462 - DNA, 20 bp, Artificial Sequence
  Description of Artificial Sequence: Synthetic oligonucleotide
tcagggtccacccggctctc

SEQ ID NO: 13463 - DNA, 20 bp, Artificial Sequence
  Description of Artificial Sequence: Synthetic oligonucleotide
cagggtccacccggctctca

SEQ ID NO: 13464 - DNA, 20 bp, Artificial Sequence
  Description of Artificial Sequence: Synthetic oligonucleotide
agggtccacccggctctcag

SEQ ID NO: 13465 - DNA, 20 bp, Artificial Sequence
  Description of Artificial Sequence: Synthetic oligonucleotide
gggtccacccggctctcagg

SEQ ID NO: 13466 - DNA, 20 bp, Artificial Sequence
  Description of Artificial Sequence: Synthetic oligonucleotide
ggtccacccggctctcaggg

SEQ ID NO: 13467 - DNA, 20 bp, Artificial Sequence
  Description of Artificial Sequence: Synthetic oligonucleotide
gtccacccggctctcagggg

SEQ ID NO: 13468 - DNA, 20 bp, Artificial Sequence
  Description of Artificial Sequence: Synthetic oligonucleotide
tccacccggctctcaggggc

SEQ ID NO: 13469 - DNA, 20 bp, Artificial Sequence
  Description of Artificial Sequence: Synthetic oligonucleotide
ccacccggctctcaggggct

SEQ ID NO: 13470 - DNA, 20 bp, Artificial Sequence
  Description of Artificial Sequence: Synthetic oligonucleotide
cacccggctctcaggggcta

SEQ ID NO: 13471 - DNA, 20 bp, Artificial Sequence
  Description of Artificial Sequence: Synthetic oligonucleotide
acccggctctcaggggctaa

SEQ ID NO: 13472 - DNA, 20 bp, Artificial Sequence
  Description of Artificial Sequence: Synthetic oligonucleotide
cccggctctcaggggctaac

SEQ ID NO: 13473 - DNA, 20 bp, Artificial Sequence
  Description of Artificial Sequence: Synthetic oligonucleotide
ccggctctcaggggctaacg

SEQ ID NO: 13474 - DNA, 20 bp, Artificial Sequence
  Description of Artificial Sequence: Synthetic oligonucleotide
cggctctcaggggctaacgg

SEQ ID NO: 13475 - DNA, 20 bp, Artificial Sequence
  Description of Artificial Sequence: Synthetic oligonucleotide
ggctctcaggggctaacggg

SEQ ID NO: 13476 - DNA, 20 bp, Artificial Sequence
  Description of Artificial Sequence: Synthetic oligonucleotide
gctctcaggggctaacggga

SEQ ID NO: 13477 - DNA, 20 bp, Artificial Sequence
  Description of Artificial Sequence: Synthetic oligonucleotide
ctctcaggggctaacgggag

SEQ ID NO: 13478 - DNA, 20 bp, Artificial Sequence
  Description of Artificial Sequence: Synthetic oligonucleotide
tctcaggggctaacgggagg

SEQ ID NO: 13479 - DNA, 20 bp, Artificial Sequence
  Description of Artificial Sequence: Synthetic oligonucleotide
ctcaggggctaacgggaggt

SEQ ID NO: 13480 - DNA, 20 bp, Artificial Sequence
  Description of Artificial Sequence: Synthetic oligonucleotide
tcaggggctaacgggaggtc

SEQ ID NO: 13481 - DNA, 20 bp, Artificial Sequence
  Description of Artificial Sequence: Synthetic oligonucleotide
caggggctaacgggaggtcg

SEQ ID NO: 13482 - DNA, 20 bp, Artificial Sequence
  Description of Artificial Sequence: Synthetic oligonucleotide
aggggctaacgggaggtcgg

SEQ ID NO: 13483 - DNA, 20 bp, Artificial Sequence
  Description of Artificial Sequence: Synthetic oligonucleotide
ggggctaacgggaggtcggt

SEQ ID NO: 13484 - DNA, 20 bp, Artificial Sequence
  Description of Artificial Sequence: Synthetic oligonucleotide
gggctaacgggaggtcggtg

SEQ ID NO: 13485 - DNA, 20 bp, Artificial Sequence
  Description of Artificial Sequence: Synthetic oligonucleotide
ggctaacgggaggtcggtgg

SEQ ID NO: 13486 - DNA, 20 bp, Artificial Sequence
  Description of Artificial Sequence: Synthetic oligonucleotide
gctaacgggaggtcggtgga

SEQ ID NO: 13487 - DNA, 20 bp, Artificial Sequence
  Description of Artificial Sequence: Synthetic oligonucleotide
ctaacgggaggtcggtggac

SEQ ID NO: 13488 - DNA, 20 bp, Artificial Sequence
  Description of Artificial Sequence: Synthetic oligonucleotide
taacgggaggtcggtggacc

SEQ ID NO: 13489 - DNA, 20 bp, Artificial Sequence
  Description of Artificial Sequence: Synthetic oligonucleotide
aacgggaggtcggtggaccc

SEQ ID NO: 13490 - DNA, 20 bp, Artificial Sequence
  Description of Artificial Sequence: Synthetic oligonucleotide
acgggaggtcggtggacccc

SEQ ID NO: 13491 - DNA, 20 bp, Artificial Sequence
  Description of Artificial Sequence: Synthetic oligonucleotide
cgggaggtcggtggacccct

SEQ ID NO: 13492 - DNA, 20 bp, Artificial Sequence
  Description of Artificial Sequence: Synthetic oligonucleotide
gggaggtcggtggacccctc

SEQ ID NO: 13493 - DNA, 20 bp, Artificial Sequence
  Description of Artificial Sequence: Synthetic oligonucleotide
ggaggtcggtggacccctcg

SEQ ID NO: 13494 - DNA, 20 bp, Artificial Sequence
  Description of Artificial Sequence: Synthetic oligonucleotide
gaggtcggtggacccctcgg

SEQ ID NO: 13495 - DNA, 20 bp, Artificial Sequence
  Description of Artificial Sequence: Synthetic oligonucleotide
aggtcggtggacccctcggt

SEQ ID NO: 13496 - DNA, 20 bp, Artificial Sequence
  Description of Artificial Sequence: Synthetic oligonucleotide
ggtcggtggacccctcggtt

SEQ ID NO: 13497 - DNA, 20 bp, Artificial Sequence
  Description of Artificial Sequence: Synthetic oligonucleotide
gtcggtggacccctcggttc

SEQ ID NO: 13498 - DNA, 20 bp, Artificial Sequence
  Description of Artificial Sequence: Synthetic oligonucleotide
tcggtggacccctcggttcc

SEQ ID NO: 13499 - DNA, 20 bp, Artificial Sequence
  Description of Artificial Sequence: Synthetic oligonucleotide
cggtggacccctcggttccc

SEQ ID NO: 13500 - DNA, 20 bp, Artificial Sequence
  Description of Artificial Sequence: Synthetic oligonucleotide
ggtggacccctcggttccct

SEQ ID NO: 13501 - DNA, 20 bp, Artificial Sequence
  Description of Artificial Sequence: Synthetic oligonucleotide
gtggacccctcggttccctg

SEQ ID NO: 13502 - DNA, 20 bp, Artificial Sequence
  Description of Artificial Sequence: Synthetic oligonucleotide
tggacccctcggttccctga

SEQ ID NO: 13503 - DNA, 20 bp, Artificial Sequence
  Description of Artificial Sequence: Synthetic oligonucleotide
ggacccctcggttccctgac

SEQ ID NO: 13504 - DNA, 20 bp, Artificial Sequence
  Description of Artificial Sequence: Synthetic oligonucleotide
gacccctcggttccctgaca

SEQ ID NO: 13505 - DNA, 20 bp, Artificial Sequence
  Description of Artificial Sequence: Synthetic oligonucleotide
acccctcggttccctgacag

SEQ ID NO: 13506 - DNA, 20 bp, Artificial Sequence
  Description of Artificial Sequence: Synthetic oligonucleotide
cccctcggttccctgacagg

SEQ ID NO: 13507 - DNA, 20 bp, Artificial Sequence
  Description of Artificial Sequence: Synthetic oligonucleotide
ccctcggttccctgacaggc

SEQ ID NO: 13508 - DNA, 20 bp, Artificial Sequence
  Description of Artificial Sequence: Synthetic oligonucleotide
cctcggttccctgacaggcg

SEQ ID NO: 13509 - DNA, 20 bp, Artificial Sequence
  Description of Artificial Sequence: Synthetic oligonucleotide
ctcggttccctgacaggcgg

SEQ ID NO: 13510 - DNA, 20 bp, Artificial Sequence
  Description of Artificial Sequence: Synthetic oligonucleotide
tcggttccctgacaggcgga

SEQ ID NO: 13511 - DNA, 20 bp, Artificial Sequence
  Description of Artificial Sequence: Synthetic oligonucleotide
cggttccctgacaggcggac

SEQ ID NO: 13512 - DNA, 20 bp, Artificial Sequence
  Description of Artificial Sequence: Synthetic oligonucleotide
ggttccctgacaggcggacc

SEQ ID NO: 13513 - DNA, 20 bp, Artificial Sequence
  Description of Artificial Sequence: Synthetic oligonucleotide
gttccctgacaggcggaccc

SEQ ID NO: 13514 - DNA, 20 bp, Artificial Sequence
  Description of Artificial Sequence: Synthetic oligonucleotide
ttccctgacaggcggacccg

SEQ ID NO: 13515 - DNA, 20 bp, Artificial Sequence
  Description of Artificial Sequence: Synthetic oligonucleotide
tccctgacaggcggacccgc

SEQ ID NO: 13516 - DNA, 20 bp, Artificial Sequence
  Description of Artificial Sequence: Synthetic oligonucleotide
ccctgacaggcggacccgca

SEQ ID NO: 13517 - DNA, 20 bp, Artificial Sequence
  Description of Artificial Sequence: Synthetic oligonucleotide
cctgacaggcggacccgcac

SEQ ID NO: 13518 - DNA, 20 bp, Artificial Sequence
  Description of Artificial Sequence: Synthetic oligonucleotide
ctgacaggcggacccgcacg

SEQ ID NO: 13519 - DNA, 20 bp, Artificial Sequence
  Description of Artificial Sequence: Synthetic oligonucleotide
tgacaggcggacccgcacgc

SEQ ID NO: 13520 - DNA, 20 bp, Artificial Sequence
  Description of Artificial Sequence: Synthetic oligonucleotide
gacaggcggacccgcacgcg

SEQ ID NO: 13521 - DNA, 20 bp, Artificial Sequence
  Description of Artificial Sequence: Synthetic oligonucleotide
acaggcggacccgcacgcgc

SEQ ID NO: 13522 - DNA, 20 bp, Artificial Sequence
  Description of Artificial Sequence: Synthetic oligonucleotide
caggcggacccgcacgcgct

SEQ ID NO: 13523 - DNA, 20 bp, Artificial Sequence
  Description of Artificial Sequence: Synthetic oligonucleotide
aggcggacccgcacgcgctc

SEQ ID NO: 13524 - DNA, 20 bp, Artificial Sequence
  Description of Artificial Sequence: Synthetic oligonucleotide
ggcggacccgcacgcgctca

SEQ ID NO: 13525 - DNA, 20 bp, Artificial Sequence
  Description of Artificial Sequence: Synthetic oligonucleotide
gcggacccgcacgcgctcag

SEQ ID NO: 13526 - DNA, 20 bp, Artificial Sequence
  Description of Artificial Sequence: Synthetic oligonucleotide
cggacccgcacgcgctcagg

SEQ ID NO: 13527 - DNA, 20 bp, Artificial Sequence
  Description of Artificial Sequence: Synthetic oligonucleotide
ggacccgcacgcgctcaggc

SEQ ID NO: 13528 - DNA, 20 bp, Artificial Sequence
  Description of Artificial Sequence: Synthetic oligonucleotide
gacccgcacgcgctcaggcg

SEQ ID NO: 13529 - DNA, 20 bp, Artificial Sequence
  Description of Artificial Sequence: Synthetic oligonucleotide
acccgcacgcgctcaggcgc

SEQ ID NO: 13530 - DNA, 20 bp, Artificial Sequence
  Description of Artificial Sequence: Synthetic oligonucleotide
cccgcacgcgctcaggcgcc

SEQ ID NO: 13531 - DNA, 20 bp, Artificial Sequence
  Description of Artificial Sequence: Synthetic oligonucleotide
ccgcacgcgctcaggcgccg

SEQ ID NO: 13532 - DNA, 20 bp, Artificial Sequence
  Description of Artificial Sequence: Synthetic oligonucleotide
cgcacgcgctcaggcgccgc

SEQ ID NO: 13533 - DNA, 20 bp, Artificial Sequence
  Description of Artificial Sequence: Synthetic oligonucleotide
gcacgcgctcaggcgccgct

SEQ ID NO: 13534 - DNA, 20 bp, Artificial Sequence
  Description of Artificial Sequence: Synthetic oligonucleotide
cacgcgctcaggcgccgctc

SEQ ID NO: 13535 - DNA, 20 bp, Artificial Sequence
  Description of Artificial Sequence: Synthetic oligonucleotide
acgcgctcaggcgccgctcc

SEQ ID NO: 13536 - DNA, 20 bp, Artificial Sequence
  Description of Artificial Sequence: Synthetic oligonucleotide
cgcgctcaggcgccgctcca

SEQ ID NO: 13537 - DNA, 20 bp, Artificial Sequence
  Description of Artificial Sequence: Synthetic oligonucleotide
gcgctcaggcgccgctccag

SEQ ID NO: 13538 - DNA, 20 bp, Artificial Sequence
  Description of Artificial Sequence: Synthetic oligonucleotide
cgctcaggcgccgctccagc

SEQ ID NO: 13539 - DNA, 20 bp, Artificial Sequence
  Description of Artificial Sequence: Synthetic oligonucleotide
gctcaggcgccgctccagcg

SEQ ID NO: 13540 - DNA, 20 bp, Artificial Sequence
  Description of Artificial Sequence: Synthetic oligonucleotide
ctcaggcgccgctccagcgc

SEQ ID NO: 13541 - DNA, 20 bp, Artificial Sequence
  Description of Artificial Sequence: Synthetic oligonucleotide
tcaggcgccgctccagcgcg

SEQ ID NO: 13542 - DNA, 20 bp, Artificial Sequence
  Description of Artificial Sequence: Synthetic oligonucleotide
caggcgccgctccagcgcgc

SEQ ID NO: 13543 - DNA, 20 bp, Artificial Sequence
  Description of Artificial Sequence: Synthetic oligonucleotide
aggcgccgctccagcgcgct

SEQ ID NO: 13544 - DNA, 20 bp, Artificial Sequence
  Description of Artificial Sequence: Synthetic oligonucleotide
ggcgccgctccagcgcgctc

SEQ ID NO: 13545 - DNA, 20 bp, Artificial Sequence
  Description of Artificial Sequence: Synthetic oligonucleotide
gcgccgctccagcgcgctca

SEQ ID NO: 13546 - DNA, 20 bp, Artificial Sequence
  Description of Artificial Sequence: Synthetic oligonucleotide
cgccgctccagcgcgctcag

SEQ ID NO: 13547 - DNA, 20 bp, Artificial Sequence
  Description of Artificial Sequence: Synthetic oligonucleotide
gccgctccagcgcgctcagc

SEQ ID NO: 13548 - DNA, 20 bp, Artificial Sequence
  Description of Artificial Sequence: Synthetic oligonucleotide
ccgctccagcgcgctcagct

SEQ ID NO: 13549 - DNA, 20 bp, Artificial Sequence
  Description of Artificial Sequence: Synthetic oligonucleotide
cgctccagcgcgctcagctg

SEQ ID NO: 13550 - DNA, 20 bp, Artificial Sequence
  Description of Artificial Sequence: Synthetic oligonucleotide
gctccagcgcgctcagctga

SEQ ID NO: 13551 - DNA, 20 bp, Artificial Sequence
  Description of Artificial Sequence: Synthetic oligonucleotide
ctccagcgcgctcagctgac

SEQ ID NO: 13552 - DNA, 20 bp, Artificial Sequence
  Description of Artificial Sequence: Synthetic oligonucleotide
tccagcgcgctcagctgact

SEQ ID NO: 13553 - DNA, 20 bp, Artificial Sequence
  Description of Artificial Sequence: Synthetic oligonucleotide
ccagcgcgctcagctgactg

SEQ ID NO: 13554 - DNA, 20 bp, Artificial Sequence
  Description of Artificial Sequence: Synthetic oligonucleotide
cagcgcgctcagctgactgc

SEQ ID NO: 13555 - DNA, 20 bp, Artificial Sequence
  Description of Artificial Sequence: Synthetic oligonucleotide
agcgcgctcagctgactgcg

SEQ ID NO: 13556 - DNA, 20 bp, Artificial Sequence
  Description of Artificial Sequence: Synthetic oligonucleotide
gcgcgctcagctgactgcgg

SEQ ID NO: 13557 - DNA, 20 bp, Artificial Sequence
  Description of Artificial Sequence: Synthetic oligonucleotide
cgcgctcagctgactgcggg

SEQ ID NO: 13558 - DNA, 20 bp, Artificial Sequence
  Description of Artificial Sequence: Synthetic oligonucleotide
gcgctcagctgactgcgggt

SEQ ID NO: 13559 - DNA, 20 bp, Artificial Sequence
  Description of Artificial Sequence: Synthetic oligonucleotide
cgctcagctgactgcgggtg

SEQ ID NO: 13560 - DNA, 20 bp, Artificial Sequence
  Description of Artificial Sequence: Synthetic oligonucleotide
gctcagctgactgcgggtgc

SEQ ID NO: 13561 - DNA, 20 bp, Artificial Sequence
  Description of Artificial Sequence: Synthetic oligonucleotide
ctcagctgactgcgggtgcg

SEQ ID NO: 13562 - DNA, 20 bp, Artificial Sequence
  Description of Artificial Sequence: Synthetic oligonucleotide
tcagctgactgcgggtgcgc

SEQ ID NO: 13563 - DNA, 20 bp, Artificial Sequence
  Description of Artificial Sequence: Synthetic oligonucleotide
cagctgactgcgggtgcgct

SEQ ID NO: 13564 - DNA, 20 bp, Artificial Sequence
  Description of Artificial Sequence: Synthetic oligonucleotide
agctgactgcgggtgcgctc

SEQ ID NO: 13565 - DNA, 20 bp, Artificial Sequence
  Description of Artificial Sequence: Synthetic oligonucleotide
gctgactgcgggtgcgctcc

SEQ ID NO: 13566 - DNA, 20 bp, Artificial Sequence
  Description of Artificial Sequence: Synthetic oligonucleotide
ctgactgcgggtgcgctccg

SEQ ID NO: 13567 - DNA, 20 bp, Artificial Sequence
  Description of Artificial Sequence: Synthetic oligonucleotide
tgactgcgggtgcgctccgc

SEQ ID NO: 13568 - DNA, 20 bp, Artificial Sequence
  Description of Artificial Sequence: Synthetic oligonucleotide
gactgcgggtgcgctccgcg

SEQ ID NO: 13569 - DNA, 20 bp, Artificial Sequence
  Description of Artificial Sequence: Synthetic oligonucleotide
actgcgggtgcgctccgcgt

SEQ ID NO: 13570 - DNA, 20 bp, Artificial Sequence
  Description of Artificial Sequence: Synthetic oligonucleotide
ctgcgggtgcgctccgcgtg

SEQ ID NO: 13571 - DNA, 20 bp, Artificial Sequence
  Description of Artificial Sequence: Synthetic oligonucleotide
tgcgggtgcgctccgcgtgt

SEQ ID NO: 13572 - DNA, 20 bp, Artificial Sequence
  Description of Artificial Sequence: Synthetic oligonucleotide
gcgggtgcgctccgcgtgtt

SEQ ID NO: 13573 - DNA, 20 bp, Artificial Sequence
  Description of Artificial Sequence: Synthetic oligonucleotide
cgggtgcgctccgcgtgttc

SEQ ID NO: 13574 - DNA, 20 bp, Artificial Sequence
  Description of Artificial Sequence: Synthetic oligonucleotide
gggtgcgctccgcgtgttcg

SEQ ID NO: 13575 - DNA, 20 bp, Artificial Sequence
  Description of Artificial Sequence: Synthetic oligonucleotide
ggtgcgctccgcgtgttcgc

SEQ ID NO: 13576 - DNA, 20 bp, Artificial Sequence
  Description of Artificial Sequence: Synthetic oligonucleotide
gtgcgctccgcgtgttcgcg

SEQ ID NO: 13577 - DNA, 20 bp, Artificial Sequence
  Description of Artificial Sequence: Synthetic oligonucleotide
tgcgctccgcgtgttcgcgc

SEQ ID NO: 13578 - DNA, 20 bp, Artificial Sequence
  Description of Artificial Sequence: Synthetic oligonucleotide
gcgctccgcgtgttcgcgca

SEQ ID NO: 13579 - DNA, 20 bp, Artificial Sequence
  Description of Artificial Sequence: Synthetic oligonucleotide
cgctccgcgtgttcgcgcag

SEQ ID NO: 13580 - DNA, 20 bp, Artificial Sequence
  Description of Artificial Sequence: Synthetic oligonucleotide
gctccgcgtgttcgcgcagc

SEQ ID NO: 13581 - DNA, 20 bp, Artificial Sequence
  Description of Artificial Sequence: Synthetic oligonucleotide
ctccgcgtgttcgcgcagcc

SEQ ID NO: 13582 - DNA, 20 bp, Artificial Sequence
  Description of Artificial Sequence: Synthetic oligonucleotide
tccgcgtgttcgcgcagccc

SEQ ID NO: 13583 - DNA, 20 bp, Artificial Sequence
  Description of Artificial Sequence: Synthetic oligonucleotide
ccgcgtgttcgcgcagcccc

SEQ ID NO: 13584 - DNA, 20 bp, Artificial Sequence
  Description of Artificial Sequence: Synthetic oligonucleotide
cgcgtgttcgcgcagcccct

SEQ ID NO: 13585 - DNA, 20 bp, Artificial Sequence
  Description of Artificial Sequence: Synthetic oligonucleotide
gcgtgttcgcgcagcccctg

SEQ ID NO: 13586 - DNA, 20 bp, Artificial Sequence
  Description of Artificial Sequence: Synthetic oligonucleotide
cgtgttcgcgcagcccctgg

SEQ ID NO: 13587 - DNA, 20 bp, Artificial Sequence
  Description of Artificial Sequence: Synthetic oligonucleotide
gtgttcgcgcagcccctggc

SEQ ID NO: 13588 - DNA, 20 bp, Artificial Sequence
  Description of Artificial Sequence: Synthetic oligonucleotide
tgttcgcgcagcccctggcc

SEQ ID NO: 13589 - DNA, 20 bp, Artificial Sequence
  Description of Artificial Sequence: Synthetic oligonucleotide
gttcgcgcagcccctggccg

SEQ ID NO: 13590 - DNA, 20 bp, Artificial Sequence
  Description of Artificial Sequence: Synthetic oligonucleotide
ttcgcgcagcccctggccga

SEQ ID NO: 13591 - DNA, 20 bp, Artificial Sequence
  Description of Artificial Sequence: Synthetic oligonucleotide
tcgcgcagcccctggccgag

SEQ ID NO: 13592 - DNA, 20 bp, Artificial Sequence
  Description of Artificial Sequence: Synthetic oligonucleotide
cgcgcagcccctggccgagc

SEQ ID NO: 13593 - DNA, 20 bp, Artificial Sequence
  Description of Artificial Sequence: Synthetic oligonucleotide
gcgcagcccctggccgagct

SEQ ID NO: 13594 - DNA, 20 bp, Artificial Sequence
  Description of Artificial Sequence: Synthetic oligonucleotide
cgcagcccctggccgagctg

SEQ ID NO: 13595 - DNA, 20 bp, Artificial Sequence
  Description of Artificial Sequence: Synthetic oligonucleotide
gcagcccctggccgagctgc

SEQ ID NO: 13596 - DNA, 20 bp, Artificial Sequence
  Description of Artificial Sequence: Synthetic oligonucleotide
cagcccctggccgagctgca

SEQ ID NO: 13597 - DNA, 20 bp, Artificial Sequence
  Description of Artificial Sequence: Synthetic oligonucleotide
agcccctggccgagctgcag

SEQ ID NO: 13598 - DNA, 20 bp, Artificial Sequence
  Description of Artificial Sequence: Synthetic oligonucleotide
gcccctggccgagctgcagg

SEQ ID NO: 13599 - DNA, 20 bp, Artificial Sequence
  Description of Artificial Sequence: Synthetic oligonucleotide
cccctggccgagctgcagga

SEQ ID NO: 13600 - DNA, 20 bp, Artificial Sequence
  Description of Artificial Sequence: Synthetic oligonucleotide
ccctggccgagctgcaggag

SEQ ID NO: 13601 - DNA, 20 bp, Artificial Sequence
  Description of Artificial Sequence: Synthetic oligonucleotide
cctggccgagctgcaggagt

SEQ ID NO: 13602 - DNA, 20 bp, Artificial Sequence
  Description of Artificial Sequence: Synthetic oligonucleotide
ctggccgagctgcaggagtc

SEQ ID NO: 13603 - DNA, 20 bp, Artificial Sequence
  Description of Artificial Sequence: Synthetic oligonucleotide
tggccgagctgcaggagtcc

SEQ ID NO: 13604 - DNA, 20 bp, Artificial Sequence
  Description of Artificial Sequence: Synthetic oligonucleotide
ggccgagctgcaggagtccg

SEQ ID NO: 13605 - DNA, 20 bp, Artificial Sequence
  Description of Artificial Sequence: Synthetic oligonucleotide
gccgagctgcaggagtccgt

SEQ ID NO: 13606 - DNA, 20 bp, Artificial Sequence
  Description of Artificial Sequence: Synthetic oligonucleotide
ccgagctgcaggagtccgtg

SEQ ID NO: 13607 - DNA, 20 bp, Artificial Sequence
  Description of Artificial Sequence: Synthetic oligonucleotide
cgagctgcaggagtccgtgc

SEQ ID NO: 13608 - DNA, 20 bp, Artificial Sequence
  Description of Artificial Sequence: Synthetic oligonucleotide
gagctgcaggagtccgtgcg

SEQ ID NO: 13609 - DNA, 20 bp, Artificial Sequence
  Description of Artificial Sequence: Synthetic oligonucleotide
agctgcaggagtccgtgcgc

SEQ ID NO: 13610 - DNA, 20 bp, Artificial Sequence
  Description of Artificial Sequence: Synthetic oligonucleotide
gctgcaggagtccgtgcgcc

SEQ ID NO: 13611 - DNA, 20 bp, Artificial Sequence
  Description of Artificial Sequence: Synthetic oligonucleotide
ctgcaggagtccgtgcgcca

SEQ ID NO: 13612 - DNA, 20 bp, Artificial Sequence
  Description of Artificial Sequence: Synthetic oligonucleotide
tgcaggagtccgtgcgccag

SEQ ID NO: 13613 - DNA, 20 bp, Artificial Sequence
  Description of Artificial Sequence: Synthetic oligonucleotide
gcaggagtccgtgcgccagg

SEQ ID NO: 13614 - DNA, 20 bp, Artificial Sequence
  Description of Artificial Sequence: Synthetic oligonucleotide
caggagtccgtgcgccagga

SEQ ID NO: 13615 - DNA, 20 bp, Artificial Sequence
  Description of Artificial Sequence: Synthetic oligonucleotide
aggagtccgtgcgccaggac

SEQ ID NO: 13616 - DNA, 20 bp, Artificial Sequence
  Description of Artificial Sequence: Synthetic oligonucleotide
ggagtccgtgcgccaggaca

SEQ ID NO: 13617 - DNA, 20 bp, Artificial Sequence
  Description of Artificial Sequence: Synthetic oligonucleotide
gagtccgtgcgccaggacat

SEQ ID NO: 13618 - DNA, 20 bp, Artificial Sequence
  Description of Artificial Sequence: Synthetic oligonucleotide
agtccgtgcgccaggacatt

SEQ ID NO: 13619 - DNA, 20 bp, Artificial Sequence
  Description of Artificial Sequence: Synthetic oligonucleotide
gtccgtgcgccaggacattc

SEQ ID NO: 13620 - DNA, 20 bp, Artificial Sequence
  Description of Artificial Sequence: Synthetic oligonucleotide
tccgtgcgccaggacattca

SEQ ID NO: 13621 - DNA, 20 bp, Artificial Sequence
  Description of Artificial Sequence: Synthetic oligonucleotide
ccgtgcgccaggacattcat

SEQ ID NO: 13622 - DNA, 20 bp, Artificial Sequence
  Description of Artificial Sequence: Synthetic oligonucleotide
cgtgcgccaggacattcatc

SEQ ID NO: 13623 - DNA, 20 bp, Artificial Sequence
  Description of Artificial Sequence: Synthetic oligonucleotide
gtgcgccaggacattcatct

SEQ ID NO: 13624 - DNA, 20 bp, Artificial Sequence
  Description of Artificial Sequence: Synthetic oligonucleotide
tgcgccaggacattcatctc

SEQ ID NO: 13625 - DNA, 20 bp, Artificial Sequence
  Description of Artificial Sequence: Synthetic oligonucleotide
gcgccaggacattcatctcg

SEQ ID NO: 13626 - DNA, 20 bp, Artificial Sequence
  Description of Artificial Sequence: Synthetic oligonucleotide
cgccaggacattcatctcgt

SEQ ID NO: 13627 - DNA, 20 bp, Artificial Sequence
  Description of Artificial Sequence: Synthetic oligonucleotide
gccaggacattcatctcgtc

SEQ ID NO: 13628 - DNA, 20 bp, Artificial Sequence
  Description of Artificial Sequence: Synthetic oligonucleotide
ccaggacattcatctcgtcc

SEQ ID NO: 13629 - DNA, 20 bp, Artificial Sequence
  Description of Artificial Sequence: Synthetic oligonucleotide
caggacattcatctcgtccc

SEQ ID NO: 13630 - DNA, 20 bp, Artificial Sequence
  Description of Artificial Sequence: Synthetic oligonucleotide
aggacattcatctcgtccca

SEQ ID NO: 13631 - DNA, 20 bp, Artificial Sequence
  Description of Artificial Sequence: Synthetic oligonucleotide
ggacattcatctcgtcccag

SEQ ID NO: 13632 - DNA, 20 bp, Artificial Sequence
  Description of Artificial Sequence: Synthetic oligonucleotide
gacattcatctcgtcccagg

SEQ ID NO: 13633 - DNA, 20 bp, Artificial Sequence
  Description of Artificial Sequence: Synthetic oligonucleotide
acattcatctcgtcccagga

SEQ ID NO: 13634 - DNA, 20 bp, Artificial Sequence
  Description of Artificial Sequence: Synthetic oligonucleotide
cattcatctcgtcccaggac

SEQ ID NO: 13635 - DNA, 20 bp, Artificial Sequence
  Description of Artificial Sequence: Synthetic oligonucleotide
attcatctcgtcccaggacg

SEQ ID NO: 13636 - DNA, 20 bp, Artificial Sequence
  Description of Artificial Sequence: Synthetic oligonucleotide
ttcatctcgtcccaggacgc

SEQ ID NO: 13637 - DNA, 20 bp, Artificial Sequence
  Description of Artificial Sequence: Synthetic oligonucleotide
tcatctcgtcccaggacgca

SEQ ID NO: 13638 - DNA, 20 bp, Artificial Sequence
  Description of Artificial Sequence: Synthetic oligonucleotide
catctcgtcccaggacgcaa

SEQ ID NO: 13639 - DNA, 20 bp, Artificial Sequence
  Description of Artificial Sequence: Synthetic oligonucleotide
atctcgtcccaggacgcaaa

SEQ ID NO: 13640 - DNA, 20 bp, Artificial Sequence
  Description of Artificial Sequence: Synthetic oligonucleotide
tctcgtcccaggacgcaaag

SEQ ID NO: 13641 - DNA, 20 bp, Artificial Sequence
  Description of Artificial Sequence: Synthetic oligonucleotide
ctcgtcccaggacgcaaagc

SEQ ID NO: 13642 - DNA, 20 bp, Artificial Sequence
  Description of Artificial Sequence: Synthetic oligonucleotide
tcgtcccaggacgcaaagcg

SEQ ID NO: 13643 - DNA, 20 bp, Artificial Sequence
  Description of Artificial Sequence: Synthetic oligonucleotide
cgtcccaggacgcaaagcgc

SEQ ID NO: 13644 - DNA, 20 bp, Artificial Sequence
  Description of Artificial Sequence: Synthetic oligonucleotide
gtcccaggacgcaaagcgcg

SEQ ID NO: 13645 - DNA, 20 bp, Artificial Sequence
  Description of Artificial Sequence: Synthetic oligonucleotide
tcccaggacgcaaagcgcgg

SEQ ID NO: 13646 - DNA, 20 bp, Artificial Sequence
  Description of Artificial Sequence: Synthetic oligonucleotide
cccaggacgcaaagcgcggc

SEQ ID NO: 13647 - DNA, 20 bp, Artificial Sequence
  Description of Artificial Sequence: Synthetic oligonucleotide
ccaggacgcaaagcgcggcg

SEQ ID NO: 13648 - DNA, 20 bp, Artificial Sequence
  Description of Artificial Sequence: Synthetic oligonucleotide
caggacgcaaagcgcggcga

SEQ ID NO: 13649 - DNA, 20 bp, Artificial Sequence
  Description of Artificial Sequence: Synthetic oligonucleotide
aggacgcaaagcgcggcgac

SEQ ID NO: 13650 - DNA, 20 bp, Artificial Sequence
  Description of Artificial Sequence: Synthetic oligonucleotide
ggacgcaaagcgcggcgact

SEQ ID NO: 13651 - DNA, 20 bp, Artificial Sequence
  Description of Artificial Sequence: Synthetic oligonucleotide
gacgcaaagcgcggcgactt

SEQ ID NO: 13652 - DNA, 20 bp, Artificial Sequence
  Description of Artificial Sequence: Synthetic oligonucleotide
acgcaaagcgcggcgacttg

SEQ ID NO: 13653 - DNA, 20 bp, Artificial Sequence
  Description of Artificial Sequence: Synthetic oligonucleotide
cgcaaagcgcggcgacttgg

SEQ ID NO: 13654 - DNA, 20 bp, Artificial Sequence
  Description of Artificial Sequence: Synthetic oligonucleotide
gcaaagcgcggcgacttgga

SEQ ID NO: 13655 - DNA, 20 bp, Artificial Sequence
  Description of Artificial Sequence: Synthetic oligonucleotide
caaagcgcggcgacttggac

SEQ ID NO: 13656 - DNA, 20 bp, Artificial Sequence
  Description of Artificial Sequence: Synthetic oligonucleotide
aaagcgcggcgacttggact

SEQ ID NO: 13657 - DNA, 20 bp, Artificial Sequence
  Description of Artificial Sequence: Synthetic oligonucleotide
aagcgcggcgacttggactg

SEQ ID NO: 13658 - DNA, 20 bp, Artificial Sequence
  Description of Artificial Sequence: Synthetic oligonucleotide
agcgcggcgacttggactgc

SEQ ID NO: 13659 - DNA, 20 bp, Artificial Sequence
  Description of Artificial Sequence: Synthetic oligonucleotide
gcgcggcgacttggactgca

SEQ ID NO: 13660 - DNA, 20 bp, Artificial Sequence
  Description of Artificial Sequence: Synthetic oligonucleotide
cgcggcgacttggactgcac

SEQ ID NO: 13661 - DNA, 20 bp, Artificial Sequence
  Description of Artificial Sequence: Synthetic oligonucleotide
gcggcgacttggactgcacg

SEQ ID NO: 13662 - DNA, 20 bp, Artificial Sequence
  Description of Artificial Sequence: Synthetic oligonucleotide
cggcgacttggactgcacgg

SEQ ID NO: 13663 - DNA, 20 bp, Artificial Sequence
  Description of Artificial Sequence: Synthetic oligonucleotide
ggcgacttggactgcacggg

SEQ ID NO: 13664 - DNA, 20 bp, Artificial Sequence
  Description of Artificial Sequence: Synthetic oligonucleotide
gcgacttggactgcacgggt

SEQ ID NO: 13665 - DNA, 20 bp, Artificial Sequence
  Description of Artificial Sequence: Synthetic oligonucleotide
cgacttggactgcacgggtc

SEQ ID NO: 13666 - DNA, 20 bp, Artificial Sequence
  Description of Artificial Sequence: Synthetic oligonucleotide
gacttggactgcacgggtcc

SEQ ID NO: 13667 - DNA, 20 bp, Artificial Sequence
  Description of Artificial Sequence: Synthetic oligonucleotide
acttggactgcacgggtccg

SEQ ID NO: 13668 - DNA, 20 bp, Artificial Sequence
  Description of Artificial Sequence: Synthetic oligonucleotide
cttggactgcacgggtccgc

SEQ ID NO: 13669 - DNA, 20 bp, Artificial Sequence
  Description of Artificial Sequence: Synthetic oligonucleotide
ttggactgcacgggtccgcc

SEQ ID NO: 13670 - DNA, 20 bp, Artificial Sequence
  Description of Artificial Sequence: Synthetic oligonucleotide
tggactgcacgggtccgccc

SEQ ID NO: 13671 - DNA, 20 bp, Artificial Sequence
  Description of Artificial Sequence: Synthetic oligonucleotide
ggactgcacgggtccgccct

SEQ ID NO: 13672 - DNA, 20 bp, Artificial Sequence
  Description of Artificial Sequence: Synthetic oligonucleotide
gactgcacgggtccgccctg

SEQ ID NO: 13673 - DNA, 20 bp, Artificial Sequence
  Description of Artificial Sequence: Synthetic oligonucleotide
actgcacgggtccgccctga

SEQ ID NO: 13674 - DNA, 20 bp, Artificial Sequence
  Description of Artificial Sequence: Synthetic oligonucleotide
ctgcacgggtccgccctgag

SEQ ID NO: 13675 - DNA, 20 bp, Artificial Sequence
  Description of Artificial Sequence: Synthetic oligonucleotide
tgcacgggtccgccctgagc

SEQ ID NO: 13676 - DNA, 20 bp, Artificial Sequence
  Description of Artificial Sequence: Synthetic oligonucleotide
gcacgggtccgccctgagcg

SEQ ID NO: 13677 - DNA, 20 bp, Artificial Sequence
  Description of Artificial Sequence: Synthetic oligonucleotide
cacgggtccgccctgagcgc

SEQ ID NO: 13678 - DNA, 20 bp, Artificial Sequence
  Description of Artificial Sequence: Synthetic oligonucleotide
acgggtccgccctgagcgct

SEQ ID NO: 13679 - DNA, 20 bp, Artificial Sequence
  Description of Artificial Sequence: Synthetic oligonucleotide
cgggtccgccctgagcgctc

SEQ ID NO: 13680 - DNA, 20 bp, Artificial Sequence
  Description of Artificial Sequence: Synthetic oligonucleotide
gggtccgccctgagcgctca

SEQ ID NO: 13681 - DNA, 20 bp, Artificial Sequence
  Description of Artificial Sequence: Synthetic oligonucleotide
ggtccgccctgagcgctcag

SEQ ID NO: 13682 - DNA, 20 bp, Artificial Sequence
  Description of Artificial Sequence: Synthetic oligonucleotide
gtccgccctgagcgctcagt

SEQ ID NO: 13683 - DNA, 20 bp, Artificial Sequence
  Description of Artificial Sequence: Synthetic oligonucleotide
tccgccctgagcgctcagta

SEQ ID NO: 13684 - DNA, 20 bp, Artificial Sequence
  Description of Artificial Sequence: Synthetic oligonucleotide
ccgccctgagcgctcagtag

SEQ ID NO: 13685 - DNA, 20 bp, Artificial Sequence
  Description of Artificial Sequence: Synthetic oligonucleotide
cgccctgagcgctcagtagc

SEQ ID NO: 13686 - DNA, 20 bp, Artificial Sequence
  Description of Artificial Sequence: Synthetic oligonucleotide
gccctgagcgctcagtagca

SEQ ID NO: 13687 - DNA, 20 bp, Artificial Sequence
  Description of Artificial Sequence: Synthetic oligonucleotide
ccctgagcgctcagtagcac

SEQ ID NO: 13688 - DNA, 20 bp, Artificial Sequence
  Description of Artificial Sequence: Synthetic oligonucleotide
cctgagcgctcagtagcacg

SEQ ID NO: 13689 - DNA, 20 bp, Artificial Sequence
  Description of Artificial Sequence: Synthetic oligonucleotide
ctgagcgctcagtagcacgg

SEQ ID NO: 13690 - DNA, 20 bp, Artificial Sequence
  Description of Artificial Sequence: Synthetic oligonucleotide
tgagcgctcagtagcacggc

SEQ ID NO: 13691 - DNA, 20 bp, Artificial Sequence
  Description of Artificial Sequence: Synthetic oligonucleotide
gagcgctcagtagcacggcg

SEQ ID NO: 13692 - DNA, 20 bp, Artificial Sequence
  Description of Artificial Sequence: Synthetic oligonucleotide
agcgctcagtagcacggcgg

SEQ ID NO: 13693 - DNA, 20 bp, Artificial Sequence
  Description of Artificial Sequence: Synthetic oligonucleotide
gcgctcagtagcacggcggt

SEQ ID NO: 13694 - DNA, 20 bp, Artificial Sequence
  Description of Artificial Sequence: Synthetic oligonucleotide
cgctcagtagcacggcggtg

SEQ ID NO: 13695 - DNA, 20 bp, Artificial Sequence
  Description of Artificial Sequence: Synthetic oligonucleotide
gctcagtagcacggcggtgg

SEQ ID NO: 13696 - DNA, 20 bp, Artificial Sequence
  Description of Artificial Sequence: Synthetic oligonucleotide
ctcagtagcacggcggtggc

SEQ ID NO: 13697 - DNA, 20 bp, Artificial Sequence
  Description of Artificial Sequence: Synthetic oligonucleotide
tcagtagcacggcggtggcg

SEQ ID NO: 13698 - DNA, 20 bp, Artificial Sequence
  Description of Artificial Sequence: Synthetic oligonucleotide
cagtagcacggcggtggcgg

SEQ ID NO: 13699 - DNA, 20 bp, Artificial Sequence
  Description of Artificial Sequence: Synthetic oligonucleotide
agtagcacggcggtggcggc

SEQ ID NO: 13700 - DNA, 20 bp, Artificial Sequence
  Description of Artificial Sequence: Synthetic oligonucleotide
gtagcacggcggtggcggcg

SEQ ID NO: 13701 - DNA, 20 bp, Artificial Sequence
  Description of Artificial Sequence: Synthetic oligonucleotide
tagcacggcggtggcggcgc

SEQ ID NO: 13702 - DNA, 20 bp, Artificial Sequence
  Description of Artificial Sequence: Synthetic oligonucleotide
agcacggcggtggcggcgca

SEQ ID NO: 13703 - DNA, 20 bp, Artificial Sequence
  Description of Artificial Sequence: Synthetic oligonucleotide
gcacggcggtggcggcgcag

SEQ ID NO: 13704 - DNA, 20 bp, Artificial Sequence
  Description of Artificial Sequence: Synthetic oligonucleotide
cacggcggtggcggcgcaga

SEQ ID NO: 13705 - DNA, 20 bp, Artificial Sequence
  Description of Artificial Sequence: Synthetic oligonucleotide
acggcggtggcggcgcagag

SEQ ID NO: 13706 - DNA, 20 bp, Artificial Sequence
  Description of Artificial Sequence: Synthetic oligonucleotide
cggcggtggcggcgcagagc

SEQ ID NO: 13707 - DNA, 20 bp, Artificial Sequence
  Description of Artificial Sequence: Synthetic oligonucleotide
ggcggtggcggcgcagagca

SEQ ID NO: 13708 - DNA, 20 bp, Artificial Sequence
  Description of Artificial Sequence: Synthetic oligonucleotide
gcggtggcggcgcagagcat

SEQ ID NO: 13709 - DNA, 20 bp, Artificial Sequence
  Description of Artificial Sequence: Synthetic oligonucleotide
cggtggcggcgcagagcatc

SEQ ID NO: 13710 - DNA, 20 bp, Artificial Sequence
  Description of Artificial Sequence: Synthetic oligonucleotide
ggtggcggcgcagagcatca

SEQ ID NO: 13711 - DNA, 20 bp, Artificial Sequence
  Description of Artificial Sequence: Synthetic oligonucleotide
gtggcggcgcagagcatcag

SEQ ID NO: 13712 - DNA, 20 bp, Artificial Sequence
  Description of Artificial Sequence: Synthetic oligonucleotide
tggcggcgcagagcatcagg

SEQ ID NO: 13713 - DNA, 20 bp, Artificial Sequence
  Description of Artificial Sequence: Synthetic oligonucleotide
ggcggcgcagagcatcaggg

SEQ ID NO: 13714 - DNA, 20 bp, Artificial Sequence
  Description of Artificial Sequence: Synthetic oligonucleotide
gcggcgcagagcatcagggc

SEQ ID NO: 13715 - DNA, 20 bp, Artificial Sequence
  Description of Artificial Sequence: Synthetic oligonucleotide
cggcgcagagcatcagggct

SEQ ID NO: 13716 - DNA, 20 bp, Artificial Sequence
  Description of Artificial Sequence: Synthetic oligonucleotide
ggcgcagagcatcagggctg

SEQ ID NO: 13717 - DNA, 20 bp, Artificial Sequence
  Description of Artificial Sequence: Synthetic oligonucleotide
gcgcagagcatcagggctgc

SEQ ID NO: 13718 - DNA, 20 bp, Artificial Sequence
  Description of Artificial Sequence: Synthetic oligonucleotide
cgcagagcatcagggctgcc

SEQ ID NO: 13719 - DNA, 20 bp, Artificial Sequence
  Description of Artificial Sequence: Synthetic oligonucleotide
gcagagcatcagggctgccc

SEQ ID NO: 13720 - DNA, 20 bp, Artificial Sequence
  Description of Artificial Sequence: Synthetic oligonucleotide
cagagcatcagggctgcccc

SEQ ID NO: 13721 - DNA, 20 bp, Artificial Sequence
  Description of Artificial Sequence: Synthetic oligonucleotide
agagcatcagggctgccccg

SEQ ID NO: 13722 - DNA, 20 bp, Artificial Sequence
  Description of Artificial Sequence: Synthetic oligonucleotide
gagcatcagggctgccccgg

SEQ ID NO: 13723 - DNA, 20 bp, Artificial Sequence
  Description of Artificial Sequence: Synthetic oligonucleotide
agcatcagggctgccccggc

SEQ ID NO: 13724 - DNA, 20 bp, Artificial Sequence
  Description of Artificial Sequence: Synthetic oligonucleotide
gcatcagggctgccccggcc

SEQ ID NO: 13725 - DNA, 20 bp, Artificial Sequence
  Description of Artificial Sequence: Synthetic oligonucleotide
catcagggctgccccggccg

SEQ ID NO: 13726 - DNA, 20 bp, Artificial Sequence
  Description of Artificial Sequence: Synthetic oligonucleotide
atcagggctgccccggccgt

SEQ ID NO: 13727 - DNA, 20 bp, Artificial Sequence
  Description of Artificial Sequence: Synthetic oligonucleotide
tcagggctgccccggccgtc

SEQ ID NO: 13728 - DNA, 20 bp, Artificial Sequence
  Description of Artificial Sequence: Synthetic oligonucleotide
cagggctgccccggccgtcg

SEQ ID NO: 13729 - DNA, 20 bp, Artificial Sequence
  Description of Artificial Sequence: Synthetic oligonucleotide
agggctgccccggccgtcgg

SEQ ID NO: 13730 - DNA, 20 bp, Artificial Sequence
  Description of Artificial Sequence: Synthetic oligonucleotide
gggctgccccggccgtcgga

SEQ ID NO: 13731 - DNA, 20 bp, Artificial Sequence
  Description of Artificial Sequence: Synthetic oligonucleotide
ggctgccccggccgtcggag

SEQ ID NO: 13732 - DNA, 20 bp, Artificial Sequence
  Description of Artificial Sequence: Synthetic oligonucleotide
gctgccccggccgtcggagc

SEQ ID NO: 13733 - DNA, 20 bp, Artificial Sequence
  Description of Artificial Sequence: Synthetic oligonucleotide
ctgccccggccgtcggagca

SEQ ID NO: 13734 - DNA, 20 bp, Artificial Sequence
  Description of Artificial Sequence: Synthetic oligonucleotide
tgccccggccgtcggagcac

SEQ ID NO: 13735 - DNA, 20 bp, Artificial Sequence
  Description of Artificial Sequence: Synthetic oligonucleotide
gccccggccgtcggagcacc

SEQ ID NO: 13736 - DNA, 20 bp, Artificial Sequence
  Description of Artificial Sequence: Synthetic oligonucleotide
ccccggccgtcggagcaccg

SEQ ID NO: 13737 - DNA, 20 bp, Artificial Sequence
  Description of Artificial Sequence: Synthetic oligonucleotide
cccggccgtcggagcaccgc

SEQ ID NO: 13738 - DNA, 20 bp, Artificial Sequence
  Description of Artificial Sequence: Synthetic oligonucleotide
ccggccgtcggagcaccgct

SEQ ID NO: 13739 - DNA, 20 bp, Artificial Sequence
  Description of Artificial Sequence: Synthetic oligonucleotide
cggccgtcggagcaccgctc

SEQ ID NO: 13740 - DNA, 20 bp, Artificial Sequence
  Description of Artificial Sequence: Synthetic oligonucleotide
ggccgtcggagcaccgctca

SEQ ID NO: 13741 - DNA, 20 bp, Artificial Sequence
  Description of Artificial Sequence: Synthetic oligonucleotide
gccgtcggagcaccgctcat

SEQ ID NO: 13742 - DNA, 20 bp, Artificial Sequence
  Description of Artificial Sequence: Synthetic oligonucleotide
ccgtcggagcaccgctcatc

SEQ ID NO: 13743 - DNA, 20 bp, Artificial Sequence
  Description of Artificial Sequence: Synthetic oligonucleotide
cgtcggagcaccgctcatcc

SEQ ID NO: 13744 - DNA, 20 bp, Artificial Sequence
  Description of Artificial Sequence: Synthetic oligonucleotide
gtcggagcaccgctcatcct

SEQ ID NO: 13745 - DNA, 20 bp, Artificial Sequence
  Description of Artificial Sequence: Synthetic oligonucleotide
tcggagcaccgctcatcctc

SEQ ID NO: 13746 - DNA, 20 bp, Artificial Sequence
  Description of Artificial Sequence: Synthetic oligonucleotide
cggagcaccgctcatcctct

SEQ ID NO: 13747 - DNA, 20 bp, Artificial Sequence
  Description of Artificial Sequence: Synthetic oligonucleotide
ggagcaccgctcatcctctt

SEQ ID NO: 13748 - DNA, 20 bp, Artificial Sequence
  Description of Artificial Sequence: Synthetic oligonucleotide
gagcaccgctcatcctctta

SEQ ID NO: 13749 - DNA, 20 bp, Artificial Sequence
  Description of Artificial Sequence: Synthetic oligonucleotide
agcaccgctcatcctcttag

SEQ ID NO: 13750 - DNA, 20 bp, Artificial Sequence
  Description of Artificial Sequence: Synthetic oligonucleotide
gcaccgctcatcctcttagg

SEQ ID NO: 13751 - DNA, 20 bp, Artificial Sequence
  Description of Artificial Sequence: Synthetic oligonucleotide
caccgctcatcctcttaggt

SEQ ID NO: 13752 - DNA, 20 bp, Artificial Sequence
  Description of Artificial Sequence: Synthetic oligonucleotide
accgctcatcctcttaggta

SEQ ID NO: 13753 - DNA, 20 bp, Artificial Sequence
  Description of Artificial Sequence: Synthetic oligonucleotide
ccgctcatcctcttaggtag

SEQ ID NO: 13754 - DNA, 20 bp, Artificial Sequence
  Description of Artificial Sequence: Synthetic oligonucleotide
cgctcatcctcttaggtagc

SEQ ID NO: 13755 - DNA, 20 bp, Artificial Sequence
  Description of Artificial Sequence: Synthetic oligonucleotide
gctcatcctcttaggtagcc

SEQ ID NO: 13756 - DNA, 20 bp, Artificial Sequence
  Description of Artificial Sequence: Synthetic oligonucleotide
ctcatcctcttaggtagcct

SEQ ID NO: 13757 - DNA, 20 bp, Artificial Sequence
  Description of Artificial Sequence: Synthetic oligonucleotide
tcatcctcttaggtagcctg

SEQ ID NO: 13758 - DNA, 20 bp, Artificial Sequence
  Description of Artificial Sequence: Synthetic oligonucleotide
catcctcttaggtagcctgg

SEQ ID NO: 13759 - DNA, 20 bp, Artificial Sequence
  Description of Artificial Sequence: Synthetic oligonucleotide
atcctcttaggtagcctggg

SEQ ID NO: 13760 - DNA, 20 bp, Artificial Sequence
  Description of Artificial Sequence: Synthetic oligonucleotide
tcctcttaggtagcctggga

SEQ ID NO: 13761 - DNA, 20 bp, Artificial Sequence
  Description of Artificial Sequence: Synthetic oligonucleotide
cctcttaggtagcctgggag

SEQ ID NO: 13762 - DNA, 20 bp, Artificial Sequence
  Description of Artificial Sequence: Synthetic oligonucleotide
ctcttaggtagcctgggagc

SEQ ID NO: 13763 - DNA, 20 bp, Artificial Sequence
  Description of Artificial Sequence: Synthetic oligonucleotide
tcttaggtagcctgggagcg

SEQ ID NO: 13764 - DNA, 20 bp, Artificial Sequence
  Description of Artificial Sequence: Synthetic oligonucleotide
cttaggtagcctgggagcgg

SEQ ID NO: 13765 - DNA, 20 bp, Artificial Sequence
  Description of Artificial Sequence: Synthetic oligonucleotide
ttaggtagcctgggagcggg

SEQ ID NO: 13766 - DNA, 20 bp, Artificial Sequence
  Description of Artificial Sequence: Synthetic oligonucleotide
taggtagcctgggagcgggg

SEQ ID NO: 13767 - DNA, 20 bp, Artificial Sequence
  Description of Artificial Sequence: Synthetic oligonucleotide
aggtagcctgggagcgggga

SEQ ID NO: 13768 - DNA, 20 bp, Artificial Sequence
  Description of Artificial Sequence: Synthetic oligonucleotide
ggtagcctgggagcggggat

SEQ ID NO: 13769 - DNA, 20 bp, Artificial Sequence
  Description of Artificial Sequence: Synthetic oligonucleotide
gtagcctgggagcggggatt

SEQ ID NO: 13770 - DNA, 20 bp, Artificial Sequence
  Description of Artificial Sequence: Synthetic oligonucleotide
tagcctgggagcggggattc

SEQ ID NO: 13771 - DNA, 20 bp, Artificial Sequence
  Description of Artificial Sequence: Synthetic oligonucleotide
agcctgggagcggggattcg

SEQ ID NO: 13772 - DNA, 20 bp, Artificial Sequence
  Description of Artificial Sequence: Synthetic oligonucleotide
gcctgggagcggggattcgg

SEQ ID NO: 13773 - DNA, 20 bp, Artificial Sequence
  Description of Artificial Sequence: Synthetic oligonucleotide
cctgggagcggggattcggg

SEQ ID NO: 13774 - DNA, 20 bp, Artificial Sequence
  Description of Artificial Sequence: Synthetic oligonucleotide
ctgggagcggggattcgggg

SEQ ID NO: 13775 - DNA, 20 bp, Artificial Sequence
  Description of Artificial Sequence: Synthetic oligonucleotide
tgggagcggggattcgggga

SEQ ID NO: 13776 - DNA, 20 bp, Artificial Sequence
  Description of Artificial Sequence: Synthetic oligonucleotide
gggagcggggattcggggac

SEQ ID NO: 13777 - DNA, 20 bp, Artificial Sequence
  Description of Artificial Sequence: Synthetic oligonucleotide
ggagcggggattcggggact

SEQ ID NO: 13778 - DNA, 20 bp, Artificial Sequence
  Description of Artificial Sequence: Synthetic oligonucleotide
gagcggggattcggggactc

SEQ ID NO: 13779 - DNA, 20 bp, Artificial Sequence
  Description of Artificial Sequence: Synthetic oligonucleotide
agcggggattcggggactct

SEQ ID NO: 13780 - DNA, 20 bp, Artificial Sequence
  Description of Artificial Sequence: Synthetic oligonucleotide
gcggggattcggggactctc

SEQ ID NO: 13781 - DNA, 20 bp, Artificial Sequence
  Description of Artificial Sequence: Synthetic oligonucleotide
cggggattcggggactctcg

SEQ ID NO: 13782 - DNA, 20 bp, Artificial Sequence
  Description of Artificial Sequence: Synthetic oligonucleotide
ggggattcggggactctcgg

SEQ ID NO: 13783 - DNA, 20 bp, Artificial Sequence
  Description of Artificial Sequence: Synthetic oligonucleotide
gggattcggggactctcggg

SEQ ID NO: 13784 - DNA, 20 bp, Artificial Sequence
  Description of Artificial Sequence: Synthetic oligonucleotide
ggattcggggactctcgggg

SEQ ID NO: 13785 - DNA, 20 bp, Artificial Sequence
  Description of Artificial Sequence: Synthetic oligonucleotide
gattcggggactctcgggga

SEQ ID NO: 13786 - DNA, 20 bp, Artificial Sequence
  Description of Artificial Sequence: Synthetic oligonucleotide
attcggggactctcggggac

SEQ ID NO: 13787 - DNA, 20 bp, Artificial Sequence
  Description of Artificial Sequence: Synthetic oligonucleotide
ttcggggactctcggggacg

SEQ ID NO: 13788 - DNA, 20 bp, Artificial Sequence
  Description of Artificial Sequence: Synthetic oligonucleotide
tcggggactctcggggacgt

SEQ ID NO: 13789 - DNA, 20 bp, Artificial Sequence
  Description of Artificial Sequence: Synthetic oligonucleotide
cggggactctcggggacgtt

SEQ ID NO: 13790 - DNA, 20 bp, Artificial Sequence
  Description of Artificial Sequence: Synthetic oligonucleotide
ggggactctcggggacgttg

SEQ ID NO: 13791 - DNA, 20 bp, Artificial Sequence
  Description of Artificial Sequence: Synthetic oligonucleotide
gggactctcggggacgttgg

SEQ ID NO: 13792 - DNA, 20 bp, Artificial Sequence
  Description of Artificial Sequence: Synthetic oligonucleotide
ggactctcggggacgttggg

SEQ ID NO: 13793 - DNA, 20 bp, Artificial Sequence
  Description of Artificial Sequence: Synthetic oligonucleotide
gactctcggggacgttgggg

SEQ ID NO: 13794 - DNA, 20 bp, Artificial Sequence
  Description of Artificial Sequence: Synthetic oligonucleotide
actctcggggacgttggggt

SEQ ID NO: 13795 - DNA, 20 bp, Artificial Sequence
  Description of Artificial Sequence: Synthetic oligonucleotide
ctctcggggacgttggggtt

SEQ ID NO: 13796 - DNA, 20 bp, Artificial Sequence
  Description of Artificial Sequence: Synthetic oligonucleotide
tctcggggacgttggggttc

SEQ ID NO: 13797 - DNA, 20 bp, Artificial Sequence
  Description of Artificial Sequence: Synthetic oligonucleotide
ctcggggacgttggggttcc

SEQ ID NO: 13798 - DNA, 20 bp, Artificial Sequence
  Description of Artificial Sequence: Synthetic oligonucleotide
tcggggacgttggggttcca

SEQ ID NO: 13799 - DNA, 20 bp, Artificial Sequence
  Description of Artificial Sequence: Synthetic oligonucleotide
cggggacgttggggttccag

SEQ ID NO: 13800 - DNA, 20 bp, Artificial Sequence
  Description of Artificial Sequence: Synthetic oligonucleotide
ggggacgttggggttccagg

SEQ ID NO: 13801 - DNA, 20 bp, Artificial Sequence
  Description of Artificial Sequence: Synthetic oligonucleotide
gggacgttggggttccaggt

SEQ ID NO: 13802 - DNA, 20 bp, Artificial Sequence
  Description of Artificial Sequence: Synthetic oligonucleotide
ggacgttggggttccaggtg

SEQ ID NO: 13803 - DNA, 20 bp, Artificial Sequence
  Description of Artificial Sequence: Synthetic oligonucleotide
gacgttggggttccaggtgc

SEQ ID NO: 13804 - DNA, 20 bp, Artificial Sequence
  Description of Artificial Sequence: Synthetic oligonucleotide
acgttggggttccaggtgcg

SEQ ID NO: 13805 - DNA, 20 bp, Artificial Sequence
  Description of Artificial Sequence: Synthetic oligonucleotide
cgttggggttccaggtgcga

SEQ ID NO: 13806 - DNA, 20 bp, Artificial Sequence
  Description of Artificial Sequence: Synthetic oligonucleotide
gttggggttccaggtgcgag

SEQ ID NO: 13807 - DNA, 20 bp, Artificial Sequence
  Description of Artificial Sequence: Synthetic oligonucleotide
ttggggttccaggtgcgagg

SEQ ID NO: 13808 - DNA, 20 bp, Artificial Sequence
  Description of Artificial Sequence: Synthetic oligonucleotide
tggggttccaggtgcgagga

SEQ ID NO: 13809 - DNA, 20 bp, Artificial Sequence
  Description of Artificial Sequence: Synthetic oligonucleotide
ggggttccaggtgcgaggac

SEQ ID NO: 13810 - DNA, 20 bp, Artificial Sequence
  Description of Artificial Sequence: Synthetic oligonucleotide
gggttccaggtgcgaggact

SEQ ID NO: 13811 - DNA, 20 bp, Artificial Sequence
  Description of Artificial Sequence: Synthetic oligonucleotide
ggttccaggtgcgaggactg

SEQ ID NO: 13812 - DNA, 20 bp, Artificial Sequence
  Description of Artificial Sequence: Synthetic oligonucleotide
gttccaggtgcgaggactgg

SEQ ID NO: 13813 - DNA, 20 bp, Artificial Sequence
  Description of Artificial Sequence: Synthetic oligonucleotide
ttccaggtgcgaggactgga

SEQ ID NO: 13814 - DNA, 20 bp, Artificial Sequence
  Description of Artificial Sequence: Synthetic oligonucleotide
tccaggtgcgaggactggag

SEQ ID NO: 13815 - DNA, 20 bp, Artificial Sequence
  Description of Artificial Sequence: Synthetic oligonucleotide
ccaggtgcgaggactggaga

SEQ ID NO: 13816 - DNA, 20 bp, Artificial Sequence
  Description of Artificial Sequence: Synthetic oligonucleotide
caggtgcgaggactggagac

SEQ ID NO: 13817 - DNA, 20 bp, Artificial Sequence
  Description of Artificial Sequence: Synthetic oligonucleotide
aggtgcgaggactggagacg

SEQ ID NO: 13818 - DNA, 20 bp, Artificial Sequence
  Description of Artificial Sequence: Synthetic oligonucleotide
ggtgcgaggactggagacgc

SEQ ID NO: 13819 - DNA, 20 bp, Artificial Sequence
  Description of Artificial Sequence: Synthetic oligonucleotide
gtgcgaggactggagacgcg

SEQ ID NO: 13820 - DNA, 20 bp, Artificial Sequence
  Description of Artificial Sequence: Synthetic oligonucleotide
tgcgaggactggagacgcgg

SEQ ID NO: 13821 - DNA, 20 bp, Artificial Sequence
  Description of Artificial Sequence: Synthetic oligonucleotide
gcgaggactggagacgcgga

SEQ ID NO: 13822 - DNA, 20 bp, Artificial Sequence
  Description of Artificial Sequence: Synthetic oligonucleotide
cgaggactggagacgcggag

SEQ ID NO: 13823 - DNA, 20 bp, Artificial Sequence
  Description of Artificial Sequence: Synthetic oligonucleotide
gaggactggagacgcggagg

SEQ ID NO: 13824 - DNA, 20 bp, Artificial Sequence
  Description of Artificial Sequence: Synthetic oligonucleotide
aggactggagacgcggagga

SEQ ID NO: 13825 - DNA, 20 bp, Artificial Sequence
  Description of Artificial Sequence: Synthetic oligonucleotide
ggactggagacgcggaggac

SEQ ID NO: 13826 - DNA, 20 bp, Artificial Sequence
  Description of Artificial Sequence: Synthetic oligonucleotide
gactggagacgcggaggacc

SEQ ID NO: 13827 - DNA, 20 bp, Artificial Sequence
  Description of Artificial Sequence: Synthetic oligonucleotide
actggagacgcggaggaccg

SEQ ID NO: 13828 - DNA, 20 bp, Artificial Sequence
  Description of Artificial Sequence: Synthetic oligonucleotide
ctggagacgcggaggaccgg

SEQ ID NO: 13829 - DNA, 20 bp, Artificial Sequence
  Description of Artificial Sequence: Synthetic oligonucleotide
tggagacgcggaggaccggg

SEQ ID NO: 13830 - DNA, 20 bp, Artificial Sequence
  Description of Artificial Sequence: Synthetic oligonucleotide
ggagacgcggaggaccgggg

SEQ ID NO: 13831 - DNA, 20 bp, Artificial Sequence
  Description of Artificial Sequence: Synthetic oligonucleotide
gagacgcggaggaccggggg

SEQ ID NO: 13832 - DNA, 20 bp, Artificial Sequence
  Description of Artificial Sequence: Synthetic oligonucleotide
agacgcggaggaccgggggt

SEQ ID NO: 13833 - DNA, 20 bp, Artificial Sequence
  Description of Artificial Sequence: Synthetic oligonucleotide
gacgcggaggaccgggggta

SEQ ID NO: 13834 - DNA, 20 bp, Artificial Sequence
  Description of Artificial Sequence: Synthetic oligonucleotide
acgcggaggaccgggggtaa

SEQ ID NO: 13835 - DNA, 20 bp, Artificial Sequence
  Description of Artificial Sequence: Synthetic oligonucleotide
cgcggaggaccgggggtaag

SEQ ID NO: 13836 - DNA, 20 bp, Artificial Sequence
  Description of Artificial Sequence: Synthetic oligonucleotide
gcggaggaccgggggtaaga

SEQ ID NO: 13837 - DNA, 20 bp, Artificial Sequence
  Description of Artificial Sequence: Synthetic oligonucleotide
cggaggaccgggggtaagac

SEQ ID NO: 13838 - DNA, 20 bp, Artificial Sequence
  Description of Artificial Sequence: Synthetic oligonucleotide
ggaggaccgggggtaagacc

SEQ ID NO: 13839 - DNA, 20 bp, Artificial Sequence
  Description of Artificial Sequence: Synthetic oligonucleotide
gaggaccgggggtaagaccc

SEQ ID NO: 13840 - DNA, 20 bp, Artificial Sequence
  Description of Artificial Sequence: Synthetic oligonucleotide
aggaccgggggtaagacccg

SEQ ID NO: 13841 - DNA, 20 bp, Artificial Sequence
  Description of Artificial Sequence: Synthetic oligonucleotide
ggaccgggggtaagacccgc

SEQ ID NO: 13842 - DNA, 20 bp, Artificial Sequence
  Description of Artificial Sequence: Synthetic oligonucleotide
gaccgggggtaagacccgct

SEQ ID NO: 13843 - DNA, 20 bp, Artificial Sequence
  Description of Artificial Sequence: Synthetic oligonucleotide
accgggggtaagacccgctt

SEQ ID NO: 13844 - DNA, 20 bp, Artificial Sequence
  Description of Artificial Sequence: Synthetic oligonucleotide
ccgggggtaagacccgcttg

SEQ ID NO: 13845 - DNA, 20 bp, Artificial Sequence
  Description of Artificial Sequence: Synthetic oligonucleotide
cgggggtaagacccgcttgg

SEQ ID NO: 13846 - DNA, 20 bp, Artificial Sequence
  Description of Artificial Sequence: Synthetic oligonucleotide
gggggtaagacccgcttggt

SEQ ID NO: 13847 - DNA, 20 bp, Artificial Sequence
  Description of Artificial Sequence: Synthetic oligonucleotide
ggggtaagacccgcttggtt

SEQ ID NO: 13848 - DNA, 20 bp, Artificial Sequence
  Description of Artificial Sequence: Synthetic oligonucleotide
gggtaagacccgcttggttg

SEQ ID NO: 13849 - DNA, 20 bp, Artificial Sequence
  Description of Artificial Sequence: Synthetic oligonucleotide
ggtaagacccgcttggttgc

SEQ ID NO: 13850 - DNA, 20 bp, Artificial Sequence
  Description of Artificial Sequence: Synthetic oligonucleotide
gtaagacccgcttggttgca

SEQ ID NO: 13851 - DNA, 20 bp, Artificial Sequence
  Description of Artificial Sequence: Synthetic oligonucleotide
taagacccgcttggttgcag

SEQ ID NO: 13852 - DNA, 20 bp, Artificial Sequence
  Description of Artificial Sequence: Synthetic oligonucleotide
aagacccgcttggttgcaga

SEQ ID NO: 13853 - DNA, 20 bp, Artificial Sequence
  Description of Artificial Sequence: Synthetic oligonucleotide
agacccgcttggttgcagaa

SEQ ID NO: 13854 - DNA, 20 bp, Artificial Sequence
  Description of Artificial Sequence: Synthetic oligonucleotide
gacccgcttggttgcagaag

SEQ ID NO: 13855 - DNA, 20 bp, Artificial Sequence
  Description of Artificial Sequence: Synthetic oligonucleotide
acccgcttggttgcagaagc

SEQ ID NO: 13856 - DNA, 20 bp, Artificial Sequence
  Description of Artificial Sequence: Synthetic oligonucleotide
cccgcttggttgcagaagcc

SEQ ID NO: 13857 - DNA, 20 bp, Artificial Sequence
  Description of Artificial Sequence: Synthetic oligonucleotide
ccgcttggttgcagaagccg

SEQ ID NO: 13858 - DNA, 20 bp, Artificial Sequence
  Description of Artificial Sequence: Synthetic oligonucleotide
cgcttggttgcagaagccgc

SEQ ID NO: 13859 - DNA, 20 bp, Artificial Sequence
  Description of Artificial Sequence: Synthetic oligonucleotide
gcttggttgcagaagccgct

SEQ ID NO: 13860 - DNA, 20 bp, Artificial Sequence
  Description of Artificial Sequence: Synthetic oligonucleotide
cttggttgcagaagccgctg

SEQ ID NO: 13861 - DNA, 20 bp, Artificial Sequence
  Description of Artificial Sequence: Synthetic oligonucleotide
ttggttgcagaagccgctgg

SEQ ID NO: 13862 - DNA, 20 bp, Artificial Sequence
  Description of Artificial Sequence: Synthetic oligonucleotide
tggttgcagaagccgctgga

SEQ ID NO: 13863 - DNA, 20 bp, Artificial Sequence
  Description of Artificial Sequence: Synthetic oligonucleotide
ggttgcagaagccgctggaa

SEQ ID NO: 13864 - DNA, 20 bp, Artificial Sequence
  Description of Artificial Sequence: Synthetic oligonucleotide
gttgcagaagccgctggaaa

SEQ ID NO: 13865 - DNA, 20 bp, Artificial Sequence
  Description of Artificial Sequence: Synthetic oligonucleotide
ttgcagaagccgctggaaag

SEQ ID NO: 13866 - DNA, 20 bp, Artificial Sequence
  Description of Artificial Sequence: Synthetic oligonucleotide
tgcagaagccgctggaaaga

SEQ ID NO: 13867 - DNA, 20 bp, Artificial Sequence
  Description of Artificial Sequence: Synthetic oligonucleotide
gcagaagccgctggaaagaa

SEQ ID NO: 13868 - DNA, 20 bp, Artificial Sequence
  Description of Artificial Sequence: Synthetic oligonucleotide
cagaagccgctggaaagaat

SEQ ID NO: 13869 - DNA, 20 bp, Artificial Sequence
  Description of Artificial Sequence: Synthetic oligonucleotide
agaagccgctggaaagaatc

SEQ ID NO: 13870 - DNA, 20 bp, Artificial Sequence
  Description of Artificial Sequence: Synthetic oligonucleotide
gaagccgctggaaagaatcg

SEQ ID NO: 13871 - DNA, 20 bp, Artificial Sequence
  Description of Artificial Sequence: Synthetic oligonucleotide
aagccgctggaaagaatcgg

SEQ ID NO: 13872 - DNA, 20 bp, Artificial Sequence
  Description of Artificial Sequence: Synthetic oligonucleotide
agccgctggaaagaatcgga

SEQ ID NO: 13873 - DNA, 20 bp, Artificial Sequence
  Description of Artificial Sequence: Synthetic oligonucleotide
gccgctggaaagaatcggat

SEQ ID NO: 13874 - DNA, 20 bp, Artificial Sequence
  Description of Artificial Sequence: Synthetic oligonucleotide
ccgctggaaagaatcggatc

SEQ ID NO: 13875 - DNA, 20 bp, Artificial Sequence
  Description of Artificial Sequence: Synthetic oligonucleotide
cgctggaaagaatcggatca

SEQ ID NO: 13876 - DNA, 20 bp, Artificial Sequence
  Description of Artificial Sequence: Synthetic oligonucleotide
gctggaaagaatcggatcac

SEQ ID NO: 13877 - DNA, 20 bp, Artificial Sequence
  Description of Artificial Sequence: Synthetic oligonucleotide
ctggaaagaatcggatcaca

SEQ ID NO: 13878 - DNA, 20 bp, Artificial Sequence
  Description of Artificial Sequence: Synthetic oligonucleotide
tggaaagaatcggatcacag

SEQ ID NO: 13879 - DNA, 20 bp, Artificial Sequence
  Description of Artificial Sequence: Synthetic oligonucleotide
ggaaagaatcggatcacagt

SEQ ID NO: 13880 - DNA, 20 bp, Artificial Sequence
  Description of Artificial Sequence: Synthetic oligonucleotide
gaaagaatcggatcacagtc

SEQ ID NO: 13881 - DNA, 20 bp, Artificial Sequence
  Description of Artificial Sequence: Synthetic oligonucleotide
aaagaatcggatcacagtcg

SEQ ID NO: 13882 - DNA, 20 bp, Artificial Sequence
  Description of Artificial Sequence: Synthetic oligonucleotide
aagaatcggatcacagtcgt

SEQ ID NO: 13883 - DNA, 20 bp, Artificial Sequence
  Description of Artificial Sequence: Synthetic oligonucleotide
agaatcggatcacagtcgtg

SEQ ID NO: 13884 - DNA, 20 bp, Artificial Sequence
  Description of Artificial Sequence: Synthetic oligonucleotide
gaatcggatcacagtcgtgt

SEQ ID NO: 13885 - DNA, 20 bp, Artificial Sequence
  Description of Artificial Sequence: Synthetic oligonucleotide
aatcggatcacagtcgtgtg

SEQ ID NO: 13886 - DNA, 20 bp, Artificial Sequence
  Description of Artificial Sequence: Synthetic oligonucleotide
atcggatcacagtcgtgtga

SEQ ID NO: 13887 - DNA, 20 bp, Artificial Sequence
  Description of Artificial Sequence: Synthetic oligonucleotide
tcggatcacagtcgtgtgag

SEQ ID NO: 13888 - DNA, 20 bp, Artificial Sequence
  Description of Artificial Sequence: Synthetic oligonucleotide
cggatcacagtcgtgtgagg

SEQ ID NO: 13889 - DNA, 20 bp, Artificial Sequence
  Description of Artificial Sequence: Synthetic oligonucleotide
ggatcacagtcgtgtgagga

SEQ ID NO: 13890 - DNA, 20 bp, Artificial Sequence
  Description of Artificial Sequence: Synthetic oligonucleotide
gatcacagtcgtgtgaggat

SEQ ID NO: 13891 - DNA, 20 bp, Artificial Sequence
  Description of Artificial Sequence: Synthetic oligonucleotide
atcacagtcgtgtgaggatc

SEQ ID NO: 13892 - DNA, 20 bp, Artificial Sequence
  Description of Artificial Sequence: Synthetic oligonucleotide
tcacagtcgtgtgaggatcc

SEQ ID NO: 13893 - DNA, 20 bp, Artificial Sequence
  Description of Artificial Sequence: Synthetic oligonucleotide
cacagtcgtgtgaggatccg

SEQ ID NO: 13894 - DNA, 20 bp, Artificial Sequence
  Description of Artificial Sequence: Synthetic oligonucleotide
acagtcgtgtgaggatccgc

SEQ ID NO: 13895 - DNA, 20 bp, Artificial Sequence
  Description of Artificial Sequence: Synthetic oligonucleotide
cagtcgtgtgaggatccgct

SEQ ID NO: 13896 - DNA, 20 bp, Artificial Sequence
  Description of Artificial Sequence: Synthetic oligonucleotide
agtcgtgtgaggatccgctc

SEQ ID NO: 13897 - DNA, 20 bp, Artificial Sequence
  Description of Artificial Sequence: Synthetic oligonucleotide
gtcgtgtgaggatccgctca

SEQ ID NO: 13898 - DNA, 20 bp, Artificial Sequence
  Description of Artificial Sequence: Synthetic oligonucleotide
tcgtgtgaggatccgctcag

SEQ ID NO: 13899 - DNA, 20 bp, Artificial Sequence
  Description of Artificial Sequence: Synthetic oligonucleotide
cgtgtgaggatccgctcagc

SEQ ID NO: 13900 - DNA, 20 bp, Artificial Sequence
  Description of Artificial Sequence: Synthetic oligonucleotide
gtgtgaggatccgctcagct

SEQ ID NO: 13901 - DNA, 20 bp, Artificial Sequence
  Description of Artificial Sequence: Synthetic oligonucleotide
tgtgaggatccgctcagctc

SEQ ID NO: 13902 - DNA, 20 bp, Artificial Sequence
  Description of Artificial Sequence: Synthetic oligonucleotide
gtgaggatccgctcagctcg

SEQ ID NO: 13903 - DNA, 20 bp, Artificial Sequence
  Description of Artificial Sequence: Synthetic oligonucleotide
tgaggatccgctcagctcgg

SEQ ID NO: 13904 - DNA, 20 bp, Artificial Sequence
  Description of Artificial Sequence: Synthetic oligonucleotide
gaggatccgctcagctcggc

SEQ ID NO: 13905 - DNA, 20 bp, Artificial Sequence
  Description of Artificial Sequence: Synthetic oligonucleotide
aggatccgctcagctcggct

SEQ ID NO: 13906 - DNA, 20 bp, Artificial Sequence
  Description of Artificial Sequence: Synthetic oligonucleotide
ggatccgctcagctcggctt

SEQ ID NO: 13907 - DNA, 20 bp, Artificial Sequence
  Description of Artificial Sequence: Synthetic oligonucleotide
gatccgctcagctcggcttc

SEQ ID NO: 13908 - DNA, 20 bp, Artificial Sequence
  Description of Artificial Sequence: Synthetic oligonucleotide
atccgctcagctcggcttct

SEQ ID NO: 13909 - DNA, 20 bp, Artificial Sequence
  Description of Artificial Sequence: Synthetic oligonucleotide
tccgctcagctcggcttctc

SEQ ID NO: 13910 - DNA, 20 bp, Artificial Sequence
  Description of Artificial Sequence: Synthetic oligonucleotide
ccgctcagctcggcttctcc

SEQ ID NO: 13911 - DNA, 20 bp, Artificial Sequence
  Description of Artificial Sequence: Synthetic oligonucleotide
cgctcagctcggcttctccc

SEQ ID NO: 13912 - DNA, 20 bp, Artificial Sequence
  Description of Artificial Sequence: Synthetic oligonucleotide
gctcagctcggcttctcccc

SEQ ID NO: 13913 - DNA, 20 bp, Artificial Sequence
  Description of Artificial Sequence: Synthetic oligonucleotide
ctcagctcggcttctccccg

SEQ ID NO: 13914 - DNA, 20 bp, Artificial Sequence
  Description of Artificial Sequence: Synthetic oligonucleotide
tcagctcggcttctccccgc

SEQ ID NO: 13915 - DNA, 20 bp, Artificial Sequence
  Description of Artificial Sequence: Synthetic oligonucleotide
cagctcggcttctccccgcc

SEQ ID NO: 13916 - DNA, 20 bp, Artificial Sequence
  Description of Artificial Sequence: Synthetic oligonucleotide
agctcggcttctccccgccg

SEQ ID NO: 13917 - DNA, 20 bp, Artificial Sequence
  Description of Artificial Sequence: Synthetic oligonucleotide
gctcggcttctccccgccgc

SEQ ID NO: 13918 - DNA, 20 bp, Artificial Sequence
  Description of Artificial Sequence: Synthetic oligonucleotide
ctcggcttctccccgccgcg

SEQ ID NO: 13919 - DNA, 20 bp, Artificial Sequence
  Description of Artificial Sequence: Synthetic oligonucleotide
tcggcttctccccgccgcgc

SEQ ID NO: 13920 - DNA, 20 bp, Artificial Sequence
  Description of Artificial Sequence: Synthetic oligonucleotide
cggcttctccccgccgcgcc

SEQ ID NO: 13921 - DNA, 20 bp, Artificial Sequence
  Description of Artificial Sequence: Synthetic oligonucleotide
ggcttctccccgccgcgccc

SEQ ID NO: 13922 - DNA, 20 bp, Artificial Sequence
  Description of Artificial Sequence: Synthetic oligonucleotide
gcttctccccgccgcgcccg

SEQ ID NO: 13923 - DNA, 20 bp, Artificial Sequence
  Description of Artificial Sequence: Synthetic oligonucleotide
cttctccccgccgcgcccga

SEQ ID NO: 13924 - DNA, 20 bp, Artificial Sequence
  Description of Artificial Sequence: Synthetic oligonucleotide
ttctccccgccgcgcccgag

SEQ ID NO: 13925 - DNA, 20 bp, Artificial Sequence
  Description of Artificial Sequence: Synthetic oligonucleotide
tctccccgccgcgcccgagg

SEQ ID NO: 13926 - DNA, 20 bp, Artificial Sequence
  Description of Artificial Sequence: Synthetic oligonucleotide
ctccccgccgcgcccgagga

SEQ ID NO: 13927 - DNA, 20 bp, Artificial Sequence
  Description of Artificial Sequence: Synthetic oligonucleotide
tccccgccgcgcccgaggac

SEQ ID NO: 13928 - DNA, 20 bp, Artificial Sequence
  Description of Artificial Sequence: Synthetic oligonucleotide
ccccgccgcgcccgaggacg

SEQ ID NO: 13929 - DNA, 20 bp, Artificial Sequence
  Description of Artificial Sequence: Synthetic oligonucleotide
cccgccgcgcccgaggacgg

SEQ ID NO: 13930 - DNA, 20 bp, Artificial Sequence
  Description of Artificial Sequence: Synthetic oligonucleotide
ccgccgcgcccgaggacggt

SEQ ID NO: 13931 - DNA, 20 bp, Artificial Sequence
  Description of Artificial Sequence: Synthetic oligonucleotide
cgccgcgcccgaggacggtt

SEQ ID NO: 13932 - DNA, 20 bp, Artificial Sequence
  Description of Artificial Sequence: Synthetic oligonucleotide
gccgcgcccgaggacggttt

SEQ ID NO: 13933 - DNA, 20 bp, Artificial Sequence
  Description of Artificial Sequence: Synthetic oligonucleotide
ccgcgcccgaggacggtttt

SEQ ID NO: 13934 - DNA, 20 bp, Artificial Sequence
  Description of Artificial Sequence: Synthetic oligonucleotide
cgcgcccgaggacggttttt

SEQ ID NO: 13935 - DNA, 1872 bp, Homo sapiens
agaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 13936 - DNA, 10245 bp, Homo sapiens
aaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcaggtacgtgtccccagggctggttctccgcgcccctagtggctctcctggcttggaagggtatggacaggagtggggcgtgggggcggggtgcgcaactgtggctccctgggcttccctgcgtcaagggatgggctccccccttaggaagccgaggagggaggttcgctcaaggccaggaattcaagaccacctaaagcaaaatagcgagacccccgtctcttctacacacacacacacacacacacaaaataaataaaataaaataaaataaatataaaattaaaaaacgaccgggcgcagtggctcacggagcctccacctgctgtcgagactagcctggccaacatggagaaacctcgtctctactaaaaatacaaaaaattagcctggcatggtgtgcatgcctgtaatcccagctacttgggaggctgaggcaggagaatctcttgaacccgggaggcagaggttgcagtgagccgagatcgcagcactgcactccagcctgggcaacagagtgagactcctcaaaaaaataatagcgataaaataaaaataaagccaggtgcggtgactcacgcttgtagtcccagcactttgggagggcgaggccagtggatcacctgaggtcaggagttcaagaccagcctgaccaacacagtgaaaccccgtctctactaaaaatacaaaaattagctgggtgtggtggtgggcgcctgtaatcccagctactggggaggctgaggcaggagaacctcttgaacccgggaggcggaggttgcagtgagccgggatcatgccattgcactccagcctgggcgacagagctcgactccatctcaaaataataataataataaataaaataaaatacaaatacaaaaattagccaggtgtggtggcagctacttgggaggctgagacacaagaatcacttgagtctgggaggcagaggttgcagtgagccaagattgcgccactgcactccaacctgggtgacagagcgagactctgtctgaaaaaataaaaaataagccaggcatagagctgcatgactgtagtcccagctacacaggaggctgaaaacaggaggatcgcctgaccccaggagttggaggctgcagtgagctgtgacagcaccactgcactccagcctgggcgagagaacgagaccccgtcattgggaaaaaaaagaaaaaagaaagactcccttgcctggcctcagcggatggagatttggaaggatggatgagtggatgaattaagaggttggggtaggcaagctgggtcctcaccaaggttttcacccctccccagacacaactcaaggctcagaacagcaggatccagcaactcttccacaaggtggcccagcagcagcggcacctggagaagcagcacctgcgaattcagcatctgcaaagccaggtaaccctaggatcaagggagaaaaggtccctctgatagctggaccccaggttgagagggaggtggtgagaactggacgtgtggctggggacgtggggccaggcaggacctgacaccctcctcccgtcccatcctagtttggcctcctggaccacaagcacctagaccatgaggtggccaagcctgcccgaagaaagaggctgcccgagatggcccagccagttgacccggctcacaatgtcagccgcctgcaccgtgagtgtctgcccctcgatgctctccggtggccacccctaccccgccacttgccattgctggtcctctccttgtcaggtccaccttaaggagaagatgtcctggcctggagtccctgagggctcaccagtctctgggtcaaagctgatgggagcacctccttcctcagccctgacctggcccagccaggccacccaacccttctcctctgcaagccagtgggctgtccctgaagccctgctgatcactgattggaacagaggtggagaaagaggtcttgagggacttgagctgcaggggtgctggagaaggtagaaatggggttcggggtgccatcctgaaggttagaaccttctaggggagggtgtcatggaggagggggtgccaggtagtagtgtttgtagatttgggccctccacaatgtcttggggtatgtgggaattagggctgggaacccccagctcccagaccagaaacactcttgtatcttacaaatccaatgctccaggtccctgacccctcttcctccttcctctcttgttctcctcctccctccccgcccccgccggccccctccccaccgcagaaagtgggcttttgctgccaccacaagttgtaggtgctttattcccaaatctccgttcatctcgaaccacagcatgtccacgtgtgtccgatgcagactcgcggttctctaagttcacggccccacacggtttctctgtggtcctcatccttccctgcatctgtggctgtccacagccaactgggtgaaagtttggatccccctctcacaccctagggtcagtggcaggcttccagcactgtagacctgagggttctctcctccccaagctcccgctccttcccacctccgtgctgcccgcccccaaccccgccaggctagcatctcagcgtggtcagggtcctgtccaccctcccaaagccaccatcccaggatgaggggcttctggagggtgacgggggaaggcacaagtcctggctgggaaatgcggtggaagggggcaggggttctgtgggttcgggactcccagactcttggctcaggcccgccaagtaggagaaagttcagagctgggaaggcgaacagctggcattcatggaagccacactggtggtttggccgcgtgcccatccttactggatgggaggaaagtaggggaaaggggagatgcctgaggggccggaaagcgtcttcctggtcactctgggcccgcccccacccccaccgtgcagactcatttcgacctttcccctacttttccggctgggctgggggcggttcctcccagtctggagcgtctgagcctccagacgtgctcaacgccatcctcccctcctccctccctctttctttcctcaaccctgcctcctctccctctaggagctgggaccccaggcagagcctctgagatgctcctgctcagcacagttcttcccgttctggacctgctgcctcattcattcattcattcattcatttgtcaagactgttttgtttgctttttgagacggagtctcgctctgttgtccaggctggagtgcagtggcgcaatctcagctcactgcaacctctgcctcccactgggttcaagtgattctcctgcctcagcctctcaagtagatgggattataggcgcctaccgccaccacgcccagctaatttttattcatttatcaagtcttttttttttttgagacagagtctcactctgtcacccaggttggagtgcaatggttcaacctcagctgactgcaacctctgcctcccgggttcaagtgattctcctgcctctgcctcctaaggagctgggattactggcgtccaccatcacacccagctaatctttgtatgttttactagagatggggtttggccatgttgaccaggctggtctcaaactcctgaccgatccgcccgcctcccaaagtgctggattacaggcatgaaccactgcgcccggcccattcctcaagtctttattgagcagctgctatgcgctggggcctgcgtggatgctggtgccaggctgtgggcagagctgctccttgtccccagcctcatggagcctccattgagtcagaggagagaccattagatgacctcagtgtccaggagtgggaagtccttgctcaattcccatttggggtgttctggcctggtctgggggtgaggcaaggcagggtgtccttccagaagctgggacccagagagagaagtgaggaaagagagtcccgccgggcgcagtggttcacacctgtaatcccagcactttgggaggccaaggctggcggatcacgaggtcaggagatcgagaccagtctggccaacatggtgaaacccccgtctctacaaataatgcaaaaactagtcgggcgtggtggcacatgcctgtagtcccagctgctccggaggctgcggcagaattgcttgaacctgggaggcggaggttgcagtgagccaagattgcgccactgcactccagcctggcgacagagcgagactccgtatcaaaaaacaaaacaaaaaaagagagtcccaggcagggggaacagcatgtgcaaagtccctgtggcaggacggtgtgtggtacaagggtgggaagaaagcctgtgtgccagagagggtgtgggtacagcatggcaggaggaggatgggcacgggggctggtcctccaggtgccttgtggaccatgctgaggaaggacatagggagccatggaagaggttaggcagatggcagagaggtggtcatgagataagatttgccttttacttccctggtcatccactgttaagcccccagatatgcctggctcctgagaccccccccaggggctgccctcctgtttcaagtctccactttatctcccttcagggctgcccagggattgccaggagctgttccaggttggggagaggcagagtggactatttgaaatccagcctcaggggtctccgccatttttggtgaactgcaagatgacctcaggtagggtgtgttagtccaccaggggcccctctccccataggccctgttgtctttctttaaattgaaaacaaaacaaaacaaaaaaattaaaggcagggtcttgctatgttgcccaagctggtctttttttttttttttttttttgagatggagttttgctcttggagctggagtgcaatgccacgatctcagctcactgaaacctccgcctcccgggttcaagcaattctccagcgtcagcctccccagtagctgagactacaggtgcgagcaaccacacccagctaatttttgtatttttagtagagactgggtttcaccatgttggtctggctggtctcaaactcctgacctcaaatgatttgccgactttggcctcccaaaatgctgggattataggcattagccactgctcctggcctcttttctttaaaatgcagcccttgtctgggtgtagtggctcatatctgtaatcccgacactttgggaggcctatcatgaggatcacttgagcccagaagttcgagaccagcctggacaacatagtgagagctcatctttacaaaaaattttgtaaaagtaaaaaaaaaggccaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcagaggttgcagtgagctgagatgacgccaccgcactccagcctgggcgacagagcgagactccgtccccccatcaaaaaaataaaaaagagaaaataaaataaaataaaataaaattcagcccttgctgggcatggtggcacatgcctgtagtcccagctactcgggaggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctgagcacggtggcttacacctgaaatgccagcactttgggaggctgaggcgggcaaatcacttgaggtcagaagttcaagaccagcctggccaacatggtgaaaccctatctctaccaacataaacattagccgggcgtgcctgtgattccagctgcttgtggggctgaagcacaagaatcgcttgagccccgaaggcagaggttgcagtgagctgagattgcggcactgcgatccagcctgggcaacagagtgagactccatctctaaaaaaaaaaaaaaaaaaaaagaaagcttttttttccactgagaagtcctttccattacaagaggttacaacacggggttttacccagttcagctggcccagagaggctttgcagatttccactgcctactccctcccacactcagtccctgctgggttcttgggacaaagatcttcccaaggccagcccataatattcctccctctgacccaccctcctcgagtcctccagggatgagtgagggagctgctgtcttcctgggtttggagggggtttggtgcttggcagccagatgagggagtggggtcgtctgtgaagagggacttcctggtgaccttgtacctttctgggcagatggaggctggacagtaattcagaggcgccacgatggctcagtggacttcaaccggccctgggaagcctacaaggcggggtttggggatccccacggtaggtgtttctagtggggacagaggcaggggaggaagagggaccctcagaagtggccctgcctcatggagtggcctctcccactccaggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggtgagcaggccctgccatgccacacccagccagcagcttccctccttatctttctgctgctctgtcctgccttcaaccccacattgcatctgtttcctgcccccacctcttccttacatgccgtgtgtgtgattgggccactaacttagcctatctggcctcagttttcccatcctgaaaagggtcttgaccgtctttacttttatttacttatgtgtttgtttatttatttatttatgtatttattttttgagacggagtctcactttgtcacccaggctggagtgctttgtggcacgatcttggctcactgcaagctccacctcctgagttcacaccattctcctgcctcagcctcccgagtagctgggactataggtgcccaccaccacgcctggctaatttttttgtatttttagtagagatggggtttcaccgtgttagccaggatggtctcgatctcctgacctcgtgatctgcctgcctcagcctcccaaagtgctgggattacaggcgtgagccaccgcgcccggcctacttatttattttttgagacagagtcccgctgtgtctcccaggctggagtgcaagtgacgtgatcttggctcactgcagcctccgcctcctgggttcaagtgattctcctgcctcagcctcctgagtagctgggattacaggttcccgccaccatgcacagataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctcttgagcctaggagataaggctgcagtgagctgagactgcgccactgcactcaagcctgggtgacagagtgagacccctgcctcaaaagaaaaagaaaaaatgcaggcatggtggctcacacctgtggtcccagctacttgggaggcccaggtacaagaatcacttgagcccgtaaggttgacgctgcattgagccatcaccacaccactgcactccagcctgggcaatggagccaggccctgtctcaaaaaaaattgtttttaaacttaaaaataaggccgggtgtgggggctcacacctgtaatcccagcactttgggaggccgaggtgggtggatcacctgaggtcaggagttcaaaactagcctggccaacatggtgaaaccctgtctctactaaaaatacaaaaattaggccaggcgcagtgggtcatacctgtaatcccagcactttgggaggctgaggagggtggatcacatgaggtaaggagtttgagaccaacctggccaacatggtgaaaccccctcactactaaaaatacaaaaactagccaggcgtggtggcgggtgcctgtaatcccggctactcaggaggctgaggcatgagaatcccttgaacctgggaggcagaggtgcagtgagccgagattgtgccactgcactccagcctgggagatagagtgagactcagtctcaaaaaaaaagaccaaaaattagccaggtgtggtggcaggcgcctgtaatcccagctactcgggaggctgagggaggagaatcacttaaacctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggcaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactt

SEQ ID NO: 13937 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agagcaacaggaaacaaauuu

SEQ ID NO: 13938 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auagaguggaaguauuguauu

SEQ ID NO: 13939 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auugagauuggaauggcuauu

SEQ ID NO: 13940 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucagauggaggcuggacaauu

SEQ ID NO: 13941 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agagcaacaggaaacaaauuu

SEQ ID NO: 13942 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auagaguggaaguauuguauu

SEQ ID NO: 13943 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auugagauuggaauggcuauu

SEQ ID NO: 13944 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucagauggaggcuggacaauu

SEQ ID NO: 13945 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auuuguuuccuguugcucuuu

SEQ ID NO: 13946 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacaauacuuccacucuauuu

SEQ ID NO: 13947 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagccauuccaaucucaauuu

SEQ ID NO: 13948 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuguccagccuccaucugauu

SEQ ID NO: 13949 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auuuguuuccuguugcucuuu

SEQ ID NO: 13950 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacaauacuuccacucuauuu

SEQ ID NO: 13951 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagccauuccaaucucaauuu

SEQ ID NO: 13952 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuguccagccuccaucugauu

SEQ ID NO: 13953 - DNA, 20 bp, Artificial Sequence
  Description of Artificial Sequence: Synthetic oligonucleotide
  modified_base (1)..(1): 2'O-methyl or 2'O-methoxyethyl-modified nucleoside
  misc_feature (1)..(2): Phosphorothioate linkage
  modified_base (2)..(2): 2'O-methyl or 2'O-methoxyethyl-modified nucleoside
  misc_feature (2)..(3): Phosphorothioate linkage
  modified_base (3)..(3): 2'O-methyl or 2'O-methoxyethyl-modified nucleoside
  misc_feature (3)..(4): Phosphorothioate linkage
  modified_base (4)..(4): 2'O-methyl or 2'O-methoxyethyl-modified nucleoside
  misc_feature (4)..(5): Phosphorothioate linkage
  modified_base (5)..(5): 2'O-methyl or 2'O-methoxyethyl-modified nucleoside
  misc_feature (5)..(6): Phosphorothioate linkage
  misc_feature (6)..(7): Phosphorothioate linkage
  misc_feature (7)..(8): Phosphorothioate linkage
  misc_feature (8)..(9): Phosphorothioate linkage
  misc_feature (9)..(10): Phosphorothioate linkage
  misc_feature (10)..(11): Phosphorothioate linkage
  misc_feature (11)..(12): Phosphorothioate linkage
  misc_feature (12)..(13): Phosphorothioate linkage
  misc_feature (13)..(14): Phosphorothioate linkage
  misc_feature (14)..(15): Phosphorothioate linkage
  misc_feature (15)..(16): Phosphorothioate linkage
  modified_base (16)..(16): 2'O-methyl or 2'O-methoxyethyl-modified nucleoside
  misc_feature (16)..(17): Phosphorothioate linkage
  modified_base (17)..(17): 2'O-methyl or 2'O-methoxyethyl-modified nucleoside
  misc_feature (17)..(18): Phosphorothioate linkage
  modified_base (18)..(18): 2'O-methyl or 2'O-methoxyethyl-modified nucleoside
  misc_feature (18)..(19): Phosphorothioate linkage
  modified_base (19)..(19): 2'O-methyl or 2'O-methoxyethyl-modified nucleoside
  misc_feature (19)..(20): Phosphorothioate linkage
  modified_base (20)..(20): 2'O-methyl or 2'O-methoxyethyl-modified nucleoside
tctaaccgagctgatggact

SEQ ID NO: 13954 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13955 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' O-methyl modified nucleoside
  modified_base (15)..(15): 2' O-methyl modified nucleoside
  modified_base (16)..(16): 2' O-methyl modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13956 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' O-methyl modified nucleoside
  modified_base (9)..(9): 2' fluoro-modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' O-methyl modified nucleoside
  modified_base (15)..(15): 2' O-methyl modified nucleoside
  modified_base (16)..(16): 2' O-methyl modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13957 - RNA, 22 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
  modified_base (22)..(22): Any nucleoside
nnnnnnnnnnnnnnnnnnnnnn

SEQ ID NO: 13958 - RNA, 22 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' O-methyl modified nucleoside
  modified_base (15)..(15): 2' O-methyl modified nucleoside
  modified_base (16)..(16): 2' O-methyl modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
  modified_base (22)..(22): Any nucleoside
nnnnnnnnnnnnnnnnnnnnnn

SEQ ID NO: 13959 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' O-methyl modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13960 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13961 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13962 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' O-methyl modified nucleoside
  modified_base (9)..(9): 2' O-methyl modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13963 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' O-methyl modified nucleoside
  modified_base (9)..(9): 2' O-methyl modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13964 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13965 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' fluoro-modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13966 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13967 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' O-methyl modified nucleoside
  modified_base (6)..(6): 2' O-methyl modified nucleoside
  modified_base (7)..(7): 2' O-methyl modified nucleoside
  modified_base (8)..(8): 2' O-methyl modified nucleoside
  modified_base (9)..(9): 2' O-methyl modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' O-methyl modified nucleoside
  modified_base (17)..(17): 2' O-methyl modified nucleoside
  modified_base (18)..(18): 2' O-methyl modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13968 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' O-methyl modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' O-methyl modified nucleoside
  modified_base (9)..(9): 2' O-methyl modified nucleoside
  modified_base (10)..(10): 2' O-methyl modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
nnnnnnnnnnnnnnnnnnnnn

SEQ ID NO: 13969 - DNA, 20 bp, Artificial Sequence
  Description of Artificial Sequence: Synthetic oligonucleotide
  modified_base (1)..(1): 2'O-methyl or 2'O-methoxyethyl-modified nucleoside
  misc_feature (1)..(2): Phosphorothioate linkage
  modified_base (2)..(2): 2'O-methyl or 2'O-methoxyethyl-modified nucleoside
  misc_feature (2)..(3): Phosphorothioate linkage
  modified_base (3)..(3): 2'O-methyl or 2'O-methoxyethyl-modified nucleoside
  misc_feature (3)..(4): Phosphorothioate linkage
  modified_base (4)..(4): 2'O-methyl or 2'O-methoxyethyl-modified nucleoside
  misc_feature (4)..(5): Phosphorothioate linkage
  modified_base (5)..(5): 2'O-methyl or 2'O-methoxyethyl-modified nucleoside
  misc_feature (5)..(6): Phosphorothioate linkage
  modified_base (6)..(6): a, c, t or g
  misc_feature (6)..(7): Phosphorothioate linkage
  modified_base (7)..(7): a, c, t or g
  misc_feature (7)..(8): Phosphorothioate linkage
  modified_base (8)..(8): a, c, t or g
  misc_feature (8)..(9): Phosphorothioate linkage
  modified_base (9)..(9): a, c, t or g
  misc_feature (9)..(10): Phosphorothioate linkage
  modified_base (10)..(10): a, c, t or g
  misc_feature (10)..(11): Phosphorothioate linkage
  modified_base (11)..(11): a, c, t or g
  misc_feature (11)..(12): Phosphorothioate linkage
  modified_base (12)..(12): a, c, t or g
  misc_feature (12)..(13): Phosphorothioate linkage
  modified_base (13)..(13): a, c, t or g
  misc_feature (13)..(14): Phosphorothioate linkage
  modified_base (14)..(14): a, c, t or g
  misc_feature (14)..(15): Phosphorothioate linkage
  modified_base (15)..(15): a, c, t or g
  misc_feature (15)..(16): Phosphorothioate linkage
  modified_base (16)..(16): 2'O-methyl or 2'O-methoxyethyl-modified nucleoside
  misc_feature (16)..(17): Phosphorothioate linkage
  modified_base (17)..(17): 2'O-methyl or 2'O-methoxyethyl-modified nucleoside
  misc_feature (17)..(18): Phosphorothioate linkage
  modified_base (18)..(18): 2'O-methyl or 2'O-methoxyethyl-modified nucleoside
  misc_feature (18)..(19): Phosphorothioate linkage
  modified_base (19)..(19): 2'O-methyl or 2'O-methoxyethyl-modified nucleoside
  misc_feature (19)..(20): Phosphorothioate linkage
  modified_base (20)..(20): 2'O-methyl or 2'O-methoxyethyl-modified nucleoside
nnnnnnnnnnnnnnnnnnnn

SEQ ID NO: 13970 - RNA, 19 nt, Artificial Sequence
  Description of Artificial Sequence: Synthetic oligonucleotide
cagaguggacuauuugaaa

SEQ ID NO: 13971 - RNA, 19 nt, Artificial Sequence
  Description of Artificial Sequence: Synthetic oligonucleotide
agcuuaagaagggaaucua

SEQ ID NO: 13972 - RNA, 19 nt, Artificial Sequence
  Description of Artificial Sequence: Synthetic oligonucleotide
gaucgaggcugcaggauaa

SEQ ID NO: 13973 - RNA, 19 nt, Artificial Sequence
  Description of Artificial Sequence: Synthetic oligonucleotide
cagaguucuuggaauaaaa

SEQ ID NO: 13974 - RNA, 21 nt, Artificial Sequence
  Description of Artificial Sequence: Synthetic oligonucleotide
cagaguggacuauuugaaauu

SEQ ID NO: 13975 - RNA, 21 nt, Artificial Sequence
  Description of Artificial Sequence: Synthetic oligonucleotide
agcuuaagaagggaaucuauu

SEQ ID NO: 13976 - RNA, 21 nt, Artificial Sequence
  Description of Artificial Sequence: Synthetic oligonucleotide
gaucgaggcugcaggauaauu

SEQ ID NO: 13977 - RNA, 21 nt, Artificial Sequence
  Description of Artificial Sequence: Synthetic oligonucleotide
cagaguucuuggaauaaaauu

SEQ ID NO: 13978 - RNA, 19 nt, Artificial Sequence
  Description of Artificial Sequence: Synthetic oligonucleotide
uuucaaauaguccacucug

SEQ ID NO: 13979 - RNA, 19 nt, Artificial Sequence
  Description of Artificial Sequence: Synthetic oligonucleotide
uagauucccuucuuaagcu

SEQ ID NO: 13980 - RNA, 19 nt, Artificial Sequence
  Description of Artificial Sequence: Synthetic oligonucleotide
uuauccugcagccucgauc

SEQ ID NO: 13981 - RNA, 19 nt, Artificial Sequence
  Description of Artificial Sequence: Synthetic oligonucleotide
uuuuauuccaagaacucug

SEQ ID NO: 13982 - RNA, 21 nt, Artificial Sequence
  Description of Artificial Sequence: Synthetic oligonucleotide
uuucaaauaguccacucuguu

SEQ ID NO: 13983 - RNA, 21 nt, Artificial Sequence
  Description of Artificial Sequence: Synthetic oligonucleotide
uagauucccuucuuaagcuuu

SEQ ID NO: 13984 - RNA, 21 nt, Artificial Sequence
  Description of Artificial Sequence: Synthetic oligonucleotide
uuauccugcagccucgaucuu

SEQ ID NO: 13985 - RNA, 21 nt, Artificial Sequence
  Description of Artificial Sequence: Synthetic oligonucleotide
uuuuauuccaagaacucuguu

SEQ ID NO: 13986 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 13987 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 13988 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 13989 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 13990 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 13991 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 13992 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 13993 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 13994 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 13995 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 13996 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 13997 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 13998 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 13999 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 14000 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 14001 - RNA, 21 nt, Artificial Sequence
  Description of Artificial Sequence: Synthetic oligonucleotide
  modified_base (1)..(1): 2' O-methyl modified
  modified_base (2)..(2): 2' O-methyl modified
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14002 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 14003 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 14004 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 14005 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14006 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14007 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14008 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14009 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14010 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14011 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' O-methyl modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14012 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gugauccgauucuuuccaauu

SEQ ID NO: 14013 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugauccgauucuuuccagauu

SEQ ID NO: 14014 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gauccgauucuuuccagcauu

SEQ ID NO: 14015 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auccgauucuuuccagcgauu

SEQ ID NO: 14016 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucugcaaccaagcggguauu

SEQ ID NO: 14017 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
acguccccgagaguccccauu

SEQ ID NO: 14018 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcguccugggacgagauauu

SEQ ID NO: 14019 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gggacgagaugaauguccauu

SEQ ID NO: 14020 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gacgagaugaauguccugauu

SEQ ID NO: 14021 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugaauguccuggcgcacgauu

SEQ ID NO: 14022 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaauguccuggcgcacggauu

SEQ ID NO: 14023 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aauguccuggcgcacggaauu

SEQ ID NO: 14024 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
auguccuggcgcacggacauu

SEQ ID NO: 14025 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguccuggcgcacggacuauu

SEQ ID NO: 14026 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggccaggggcugcgcgaaauu

SEQ ID NO: 14027 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccaggggcugcgcgaacaauu

SEQ ID NO: 14028 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggggcugcgcgaacacgcauu

SEQ ID NO: 14029 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggcugcgcgaacacgcggauu

SEQ ID NO: 14030 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcugcgcgaacacgcggaauu

SEQ ID NO: 14031 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cugcgcgaacacgcggagauu

SEQ ID NO: 14032 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcgcgaacacgcggagcauu

SEQ ID NO: 14033 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcgcgaacacgcggagcgauu

SEQ ID NO: 14034 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cgcgaacacgcggagcgcauu

SEQ ID NO: 14035 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcgaacacgcggagcgcaauu

SEQ ID NO: 14036 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cgaacacgcggagcgcacauu

SEQ ID NO: 14037 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aacacgcggagcgcacccauu

SEQ ID NO: 14038 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
acacgcggagcgcacccgauu

SEQ ID NO: 14039 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cacgcggagcgcacccgcauu

SEQ ID NO: 14040 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcggagcgcacccgcaguauu

SEQ ID NO: 14041 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcgcacccgcagucagcuauu

SEQ ID NO: 14042 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcacccgcagucagcugaauu

SEQ ID NO: 14043 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggaaccgagggguccaccauu

SEQ ID NO: 14044 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaaccgagggguccaccgauu

SEQ ID NO: 14045 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
accucccguuagccccugauu

SEQ ID NO: 14046 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccucccguuagccccugaauu

SEQ ID NO: 14047 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccguuagccccugagagcauu

SEQ ID NO: 14048 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcagacacaacucaaggauu

SEQ ID NO: 14049 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agacacaacucaaggcucauu

SEQ ID NO: 14050 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caggauccagcaacucuuauu

SEQ ID NO: 14051 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcaacucuuccacaaggauu

SEQ ID NO: 14052 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caacucuuccacaaggugauu

SEQ ID NO: 14053 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aacucuuccacaagguggauu

SEQ ID NO: 14054 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcaccugcgaauucagcauu

SEQ ID NO: 14055 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccuagaccaugagguggcauu

SEQ ID NO: 14056 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggccaagccugcccgaagauu

SEQ ID NO: 14057 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccaagccugcccgaagaaauu

SEQ ID NO: 14058 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agccugcccgaagaaagaauu

SEQ ID NO: 14059 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggaggcuggacaguaauauu

SEQ ID NO: 14060 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggcuggacaguaauucagauu

SEQ ID NO: 14061 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caguaauucagaggcgccauu

SEQ ID NO: 14062 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aguaauucagaggcgccaauu

SEQ ID NO: 14063 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
guaauucagaggcgccacauu

SEQ ID NO: 14064 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaauucagaggcgccacgauu

SEQ ID NO: 14065 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agaggcgccacgauggcuauu

SEQ ID NO: 14066 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggacuucaaccggcccuauu

SEQ ID NO: 14067 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggacuucaaccggcccugauu

SEQ ID NO: 14068 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucaaccggcccugggaaauu

SEQ ID NO: 14069 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cugggaagccuacaaggcauu

SEQ ID NO: 14070 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugggaagccuacaaggcgauu

SEQ ID NO: 14071 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gccuacaaggcgggguuuauu

SEQ ID NO: 14072 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacaaggcgggguuugggauu

SEQ ID NO: 14073 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggcgggguuuggggauccauu

SEQ ID NO: 14074 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gagaaggugcauagcaucauu

SEQ ID NO: 14075 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggacugggauggcaacgcauu

SEQ ID NO: 14076 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gacugggauggcaacgccauu

SEQ ID NO: 14077 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugggauggcaacgccgagauu

SEQ ID NO: 14078 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cgugcaccuggguggcgaauu

SEQ ID NO: 14079 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cuccguacccuucuccacauu

SEQ ID NO: 14080 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccguacccuucuccacuauu

SEQ ID NO: 14081 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
guacccuucuccacuuggauu

SEQ ID NO: 14082 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
acuugggaccaggaucacauu

SEQ ID NO: 14083 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uugggaccaggaucacgaauu

SEQ ID NO: 14084 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gggaccaggaucacgaccauu

SEQ ID NO: 14085 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggaccaggaucacgaccuauu

SEQ ID NO: 14086 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaccaggaucacgaccucauu

SEQ ID NO: 14087 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccaggaucacgaccuccgauu

SEQ ID NO: 14088 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caggaucacgaccuccgcauu

SEQ ID NO: 14089 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucacgaccuccgcaggauu

SEQ ID NO: 14090 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aucacgaccuccgcagggauu

SEQ ID NO: 14091 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cacgaccuccgcagggacauu

SEQ ID NO: 14092 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
acgaccuccgcagggacaauu

SEQ ID NO: 14093 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cgaccuccgcagggacaaauu

SEQ ID NO: 14094 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccgcagggacaagaacuauu

SEQ ID NO: 14095 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccgcagggacaagaacugauu

SEQ ID NO: 14096 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggccaguacuuccgcuccauu

SEQ ID NO: 14097 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gccaguacuuccgcuccaauu

SEQ ID NO: 14098 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggcggggccgcuacuaccauu

SEQ ID NO: 14099 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caggccaccaccauguugauu

SEQ ID NO: 14100 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
caccaccauguugauccaauu

SEQ ID NO: 14101 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
accauguugauccagcccauu

SEQ ID NO: 14102 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccauguugauccagcccaauu

SEQ ID NO: 14103 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gacucuuggcucugcccgauu

SEQ ID NO: 14104 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
acucuuggcucugcccgaauu

SEQ ID NO: 14105 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugccuccugagaucgaggauu

SEQ ID NO: 14106 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gccuccugagaucgaggcauu

SEQ ID NO: 14107 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ccuccugagaucgaggcuauu

SEQ ID NO: 14108 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agaggcguggaccaagggauu

SEQ ID NO: 14109 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaggcguggaccaaggggauu

SEQ ID NO: 14110 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggaccaaggggcauggaauu

SEQ ID NO: 14111 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguuguguguagguccccauu

SEQ ID NO: 14112 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
guguguagguccccugggauu

SEQ ID NO: 14113 - RNA, 21 nt, Artificial Sequence
  Description of Artificial Sequence: Synthetic oligonucleotide
  modified_base (1)..(1): 2' fluoro-modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' fluoro-modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' fluoro-modified
  modified_base (12)..(12): 2' O-methyl modified
  modified_base (13)..(13): 2' fluoro-modified
  modified_base (14)..(14): 2' O-methyl modified
  modified_base (15)..(15): 2' fluoro-modified
  modified_base (16)..(16): 2' O-methyl modified
  modified_base (17)..(17): 2' fluoro-modified
  modified_base (18)..(18): 2' O-methyl modified
  modified_base (19)..(19): 2' fluoro-modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguagguccccuggggacauu

SEQ ID NO: 14114 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugugauccgauucuuuccauu

SEQ ID NO: 14115 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cugcgaauucagcaucugauu

SEQ ID NO: 14116 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcgaauucagcaucugcauu

SEQ ID NO: 14117 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gcgaauucagcaucugcaauu

SEQ ID NO: 14118 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aaagccaguuuggccuccauu

SEQ ID NO: 14119 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggaccacaagcaccuagauu

SEQ ID NO: 14120 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguggacuauuugaaauu

SEQ ID NO: 14121 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuuggugaacugcaagauu

SEQ ID NO: 14122 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcggcagaagcuuaagaauu

SEQ ID NO: 14123 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcuuaagaagggaaucuauu

SEQ ID NO: 14124 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggccaucuggaaacuuguauu

SEQ ID NO: 14125 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gccaucuggaaacuugugauu

SEQ ID NO: 14126 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
augcguugccuccugagaauu

SEQ ID NO: 14127 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaucgaggcugcaggauaauu

SEQ ID NO: 14128 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
aucgaggcugcaggauauauu

SEQ ID NO: 14129 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcaggauaugcucagacauu

SEQ ID NO: 14130 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
augcucagacucuagaggauu

SEQ ID NO: 14131 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaauggcggacucagucauu

SEQ ID NO: 14132 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
cagaguucuuggaauaaaauu

SEQ ID NO: 14133 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
gaguucuuggaauaaaagauu

SEQ ID NO: 14134 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14135 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14136 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14137 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14138 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14139 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14140 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14141 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14142 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14143 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14144 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14145 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14146 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14147 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14148 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14149 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14150 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' O-methyl modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14151 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' O-methyl modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14152 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' O-methyl modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14153 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' O-methyl modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14154 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14155 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14156 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14157 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14158 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14159 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14160 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14161 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14162 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14163 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' fluoro-modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14164 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14165 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' O-methyl modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14166 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14167 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuggaaagaaucggaucacuu

SEQ ID NO: 14168 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuggaaagaaucggaucauu

SEQ ID NO: 14169 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcuggaaagaaucggaucuu

SEQ ID NO: 14170 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgcuggaaagaaucggauuu

SEQ ID NO: 14171 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacccgcuugguugcagaauu

SEQ ID NO: 14172 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggggacucucggggacguuu

SEQ ID NO: 14173 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaucucgucccaggacgcauu

SEQ ID NO: 14174 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggacauucaucucgucccuu

SEQ ID NO: 14175 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaggacauucaucucgucuu

SEQ ID NO: 14176 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgugcgccaggacauucauu

SEQ ID NO: 14177 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccgugcgccaggacauucuu

SEQ ID NO: 14178 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuccgugcgccaggacauuuu

SEQ ID NO: 14179 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguccgugcgccaggacauuu

SEQ ID NO: 14180 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaguccgugcgccaggacauu

SEQ ID NO: 14181 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucgcgcagccccuggccuu

SEQ ID NO: 14182 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuguucgcgcagccccugguu

SEQ ID NO: 14183 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcguguucgcgcagccccuu

SEQ ID NO: 14184 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccgcguguucgcgcagccuu

SEQ ID NO: 14185 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuccgcguguucgcgcagcuu

SEQ ID NO: 14186 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuccgcguguucgcgcaguu

SEQ ID NO: 14187 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcuccgcguguucgcgcauu

SEQ ID NO: 14188 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgcuccgcguguucgcgcuu

SEQ ID NO: 14189 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcgcuccgcguguucgcguu

SEQ ID NO: 14190 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uugcgcuccgcguguucgcuu

SEQ ID NO: 14191 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugugcgcuccgcguguucguu

SEQ ID NO: 14192 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugggugcgcuccgcguguuuu

SEQ ID NO: 14193 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgggugcgcuccgcguguuu

SEQ ID NO: 14194 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcgggugcgcuccgcguguu

SEQ ID NO: 14195 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacugcgggugcgcuccgcuu

SEQ ID NO: 14196 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagcugacugcgggugcgcuu

SEQ ID NO: 14197 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucagcugacugcgggugcuu

SEQ ID NO: 14198 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugguggaccccucgguuccuu

SEQ ID NO: 14199 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgguggaccccucgguucuu

SEQ ID NO: 14200 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaggggcuaacgggagguuu

SEQ ID NO: 14201 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucaggggcuaacgggagguu

SEQ ID NO: 14202 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcucucaggggcuaacgguu

SEQ ID NO: 14203 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccuugaguugugucugcauu

SEQ ID NO: 14204 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugagccuugaguugugucuuu

SEQ ID NO: 14205 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaagaguugcuggauccuguu

SEQ ID NO: 14206 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccuuguggaagaguugcuuu

SEQ ID NO: 14207 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaccuuguggaagaguuguu

SEQ ID NO: 14208 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccaccuuguggaagaguuuu

SEQ ID NO: 14209 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcugaauucgcaggugcuuu

SEQ ID NO: 14210 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugccaccucauggucuagguu

SEQ ID NO: 14211 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuucgggcaggcuuggccuu

SEQ ID NO: 14212 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucuucgggcaggcuugguu

SEQ ID NO: 14213 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucuuucuucgggcaggcuuu

SEQ ID NO: 14214 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uauuacuguccagccuccauu

SEQ ID NO: 14215 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucugaauuacuguccagccuu

SEQ ID NO: 14216 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggcgccucugaauuacuguu

SEQ ID NO: 14217 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuggcgccucugaauuacuuu

SEQ ID NO: 14218 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguggcgccucugaauuacuu

SEQ ID NO: 14219 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucguggcgccucugaauuauu

SEQ ID NO: 14220 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagccaucguggcgccucuuu

SEQ ID NO: 14221 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagggccgguugaaguccauu

SEQ ID NO: 14222 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucagggccgguugaaguccuu

SEQ ID NO: 14223 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucccagggccgguugaauu

SEQ ID NO: 14224 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugccuuguaggcuucccaguu

SEQ ID NO: 14225 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgccuuguaggcuucccauu

SEQ ID NO: 14226 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaaaccccgccuuguaggcuu

SEQ ID NO: 14227 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucccaaaccccgccuuguauu

SEQ ID NO: 14228 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggauccccaaaccccgccuu

SEQ ID NO: 14229 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugaugcuaugcaccuucucuu

SEQ ID NO: 14230 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcguugccaucccaguccuu

SEQ ID NO: 14231 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggcguugccaucccagucuu

SEQ ID NO: 14232 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucucggcguugccaucccauu

SEQ ID NO: 14233 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucgccacccaggugcacguu

SEQ ID NO: 14234 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguggagaaggguacggaguu

SEQ ID NO: 14235 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaguggagaaggguacggauu

SEQ ID NO: 14236 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccaaguggagaaggguacuu

SEQ ID NO: 14237 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugugauccuggucccaaguuu

SEQ ID NO: 14238 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucgugauccuggucccaauu

SEQ ID NO: 14239 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggucgugauccuggucccuu

SEQ ID NO: 14240 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaggucgugauccugguccuu

SEQ ID NO: 14241 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugaggucgugauccuggucuu

SEQ ID NO: 14242 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucggaggucgugauccugguu

SEQ ID NO: 14243 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcggaggucgugauccuguu

SEQ ID NO: 14244 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccugcggaggucgugaucuu

SEQ ID NO: 14245 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucccugcggaggucgugauuu

SEQ ID NO: 14246 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugucccugcggaggucguguu

SEQ ID NO: 14247 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uugucccugcggaggucguuu

SEQ ID NO: 14248 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuugucccugcggaggucguu

SEQ ID NO: 14249 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uaguucuugucccugcggauu

SEQ ID NO: 14250 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaguucuugucccugcgguu

SEQ ID NO: 14251 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggagcggaaguacuggccuu

SEQ ID NO: 14252 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuggagcggaaguacuggcuu

SEQ ID NO: 14253 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugguaguagcggccccgccuu

SEQ ID NO: 14254 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucaacauggugguggccuguu

SEQ ID NO: 14255 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuggaucaacauggugguguu

SEQ ID NO: 14256 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugggcuggaucaacaugguuu

SEQ ID NO: 14257 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uugggcuggaucaacaugguu

SEQ ID NO: 14258 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucgggcagagccaagagucuu

SEQ ID NO: 14259 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucgggcagagccaagaguuu

SEQ ID NO: 14260 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccucgaucucaggaggcauu

SEQ ID NO: 14261 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugccucgaucucaggaggcuu

SEQ ID NO: 14262 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagccucgaucucaggagguu

SEQ ID NO: 14263 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucccuugguccacgccucuuu

SEQ ID NO: 14264 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccccuugguccacgccucuu

SEQ ID NO: 14265 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuccaugccccuugguccauu

SEQ ID NO: 14266 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggggaccuacacacaacauu

SEQ ID NO: 14267 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucccaggggaccuacacacuu

SEQ ID NO: 14268 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' fluoro-modified
  modified_base (5)..(5): 2' O-methyl modified
  modified_base (6)..(6): 2' fluoro-modified
  modified_base (7)..(7): 2' O-methyl modified
  modified_base (8)..(8): 2' fluoro-modified
  modified_base (9)..(9): 2' O-methyl modified
  modified_base (10)..(10): 2' fluoro-modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' fluoro-modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguccccaggggaccuacauu

SEQ ID NO: 14269 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggaaagaaucggaucacauu

SEQ ID NO: 14270 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucagaugcugaauucgcaguu

SEQ ID NO: 14271 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugcagaugcugaauucgcauu

SEQ ID NO: 14272 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uugcagaugcugaauucgcuu

SEQ ID NO: 14273 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uggaggccaaacuggcuuuuu

SEQ ID NO: 14274 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuaggugcuugugguccauu

SEQ ID NO: 14275 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuucaaauaguccacucuguu

SEQ ID NO: 14276 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuugcaguucaccaaaaauu

SEQ ID NO: 14277 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucuuaagcuucugccgcuuu

SEQ ID NO: 14278 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagauucccuucuuaagcuuu

SEQ ID NO: 14279 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uacaaguuuccagauggccuu

SEQ ID NO: 14280 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucacaaguuuccagauggcuu

SEQ ID NO: 14281 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uucucaggaggcaacgcauuu

SEQ ID NO: 14282 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuauccugcagccucgaucuu

SEQ ID NO: 14283 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uauauccugcagccucgauuu

SEQ ID NO: 14284 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugucugagcauauccugcauu

SEQ ID NO: 14285 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uccucuagagucugagcauuu

SEQ ID NO: 14286 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ugacugaguccgccauugauu

SEQ ID NO: 14287 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uuuuauuccaagaacucuguu

SEQ ID NO: 14288 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ucuuuuauuccaagaacucuu

SEQ ID NO: 14289 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
ggacaauacuuccacucuauu

SEQ ID NO: 14290 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uagaguggaaguauuguccuu

SEQ ID NO: 14291 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' O-methyl modified
  misc_feature (2)..(3): Phosphorothioate linkage
  modified_base (3)..(3): 2' O-methyl modified
  modified_base (4)..(4): 2' O-methyl modified
  modified_base (5)..(5): 2' fluoro-modified
  modified_base (6)..(6): 2' O-methyl modified
  modified_base (7)..(7): 2' fluoro-modified
  modified_base (8)..(8): 2' fluoro-modified
  modified_base (9)..(9): 2' fluoro-modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' O-methyl modified
  modified_base (15)..(15): 2' O-methyl modified
  modified_base (16)..(16): 2' O-methyl modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
agcagaaucugagaauacauu

SEQ ID NO: 14292 - RNA, 21 nt, Artificial Sequence
  Description of Artificial Sequence: Synthetic oligonucleotide
  modified_base (1)..(1): 2' O-methyl modified
  misc_feature (1)..(2): Phosphorothioate linkage
  modified_base (2)..(2): 2' fluoro-modified
  misc_feature (2)..(3): Phosphorothioate linkage
  modified_base (3)..(3): 2' O-methyl modified
  modified_base (4)..(4): 2' O-methyl modified
  modified_base (5)..(5): 2' O-methyl modified
  modified_base (6)..(6): 2' fluoro-modified
  modified_base (7)..(7): 2' O-methyl modified
  modified_base (8)..(8): 2' O-methyl modified
  modified_base (9)..(9): 2' O-methyl modified
  modified_base (10)..(10): 2' O-methyl modified
  modified_base (11)..(11): 2' O-methyl modified
  modified_base (12)..(12): 2' O-methyl modified
  modified_base (13)..(13): 2' O-methyl modified
  modified_base (14)..(14): 2' fluoro-modified
  modified_base (15)..(15): 2' O-methyl modified
  modified_base (16)..(16): 2' fluoro-modified
  modified_base (17)..(17): 2' O-methyl modified
  modified_base (18)..(18): 2' O-methyl modified
  modified_base (19)..(19): 2' O-methyl modified
  misc_feature (19)..(20): Phosphorothioate linkage
  modified_base (20)..(20): 2' O-methyl modified
  misc_feature (20)..(21): Phosphorothioate linkage
  modified_base (21)..(21): 2' O-methyl modified
uguauucucagauucugcuuu

We claim:

1. A composition comprising an oligonucleotide that targets Angiopoietin like 4 (ANGPTL4) and when administered to a cell decreases expression of ANGPTL4; wherein the oligonucleotide comprises a small interfering RNA (siRNA) comprising a sense strand and an antisense strand, wherein the sense strand comprises an oligonucleotide sequence of any of SEQ ID NOS: 13971-13973 or 13975-13977 in which at least one internucleoside linkage is modified and at least one nucleoside is modified, or an oligonucleotide sequence comprising 1 or 2 nucleoside substitutions, additions, or deletions of any of 13971-13973 or 13975-13977 in which at least one internucleoside linkage is modified and at least one nucleoside is modified; and wherein the antisense strand comprises an oligonucleotide sequence of any of SEQ ID NOS: 13979-13981 or 13983-13985 in which at least one internucleoside linkage is modified and at least one nucleoside is modified, or an oligonucleotide sequence comprising 1 or 2 nucleoside substitutions, additions, or deletions of any of SEQ ID NOS:

13979-13981 or 13983-13985 in which at least one internucleoside linkage is modified and at least one nucleoside is modified.

2. The composition of claim 1, wherein the at least one nucleoside is modified comprises a 2'-fluoro modified nucleoside.

3. The composition of claim 1, wherein the at least one nucleoside is modified comprises a 2'-O-methyl modified nucleoside.

4. The composition of claim 1, wherein the oligonucleotide comprises 15-23 modified nucleosides.

5. The composition of claim 4, wherein the 15-23 modified nucleosides comprises 2'-fluoro modified nucleosides and 2'-O-methyl modified nucleosides.

6. The composition of claim 1, wherein the at least one internucleoside linkage is modified comprises a phosphorothioate linkage.

7. The composition of claim 1, wherein the oligonucleotide comprises a GalNAc ligand attached to the oligonucleotide.

8. The composition of claim 7, wherein the GalNAc ligand comprises 3 GalNAc moieties.

9. The composition of claim 7, wherein the GalNAc ligand attached to the oligonucleotide comprises a GalNAc ligand attached at a 5' or 3' terminus of the sense strand.

10. The composition of claim 1, wherein the antisense strand comprises the nucleoside sequence of any of SEQ ID NOS: 13979-13981 or 13983-13985, and wherein the sense strand comprises the nucleoside sequence of any of SEQ ID NOS: 13971-13973 or 13975-13977.

11. The composition of claim 1, wherein the sense strand or the antisense strand comprises a 3' overhang.

12. A composition comprising an oligonucleotide that targets Angiopoietin like 4 (ANGPTL4) and when administered to a cell decreases expression of ANGPTL4; wherein the oligonucleotide comprises a small interfering RNA (siRNA) comprising a sense strand and an antisense strand, wherein the sense strand comprises an oligonucleotide sequence of any of SEQ ID NOS: 13970-13977 in which at least one internucleoside linkage is modified and at least one nucleoside is modified, or an oligonucleotide sequence comprising 1 or 2 nucleoside substitutions, additions, or deletions of any of SEQ ID NOS: 13970-13977 in which at least one internucleoside linkage is modified and at least one nucleoside is modified; wherein the antisense strand comprises an oligonucleotide sequence of any of SEQ ID NOS: 13978-13985 in which at least one internucleoside linkage is modified and at least one nucleoside is modified, or an oligonucleotide sequence comprising 1 or 2 nucleoside substitutions, additions, or deletions of any of SEQ ID NOS: 13978-13985 in which at least one internucleoside linkage is modified and at least one nucleoside is modified; and
  wherein the sense strand or the antisense strand comprises one of the following modification patterns:
  5'-NfsnsNfnNfnNfNfNfnNfnNfnNfnNfnNfsnsn-3' (SEQ ID NO: 13954), 5'-nsnsnnNfnNfNf NfnnnnnnnnnnsnsN-3' (SEQ ID NO: 13955), 5'-nsnsnnNfnNfnNfnnnnnnnnnnnsnsn-3' (SEQ ID NO: 13956), 5'-NfsnsNfnNfnNfNfNfnNfnNfnNfn NfnNfs nsnN-3' (SEQ ID NO: 13957), 5'-nsnsnnNfnNfNfNfnn nnnnnnnnnsnsN-3' (SEQ ID NO: 13958), 5'-NfsnsN fnNfnNfnNfnNfnNfnNfnNfnNfnNfsnsn-3' (SEQ ID NO: 13959), 5'-nsNfsnNfnNfnNfnNfnnnNfnNfnNfnsnsn-3' (SEQ ID NO: 13960), 5'-nsNfsnnnNfnNf NfnnnnNfnNfnnnsnsn-3' (SEQ ID NO: 13961), 5'-nsNfsnnnNfnnnnnnnnNfnNfnnnsnsn-3' (SEQ ID NO: 13962), 5'-nsNfsnNfnNfnnnnnnnnNfnNfnnnsnsn-3' (SEQ ID NO: 13963), 5'-nsNfsnnnNfn NfnnnnnNfnNfnnnsnsn-3' (SEQ ID NO: 13964), 5'-nsNfsnNfnNfnNfnNfnNfnNfnNfnNfsnsn-3' (SEQ ID NO: 13965), 5'-nsNfsnNfnNfnNfNf nnnnNfnNfnnnsnsn-3' (SEQ ID NO: 13966), 5'-nsNfsnnnnnnnnnnNfnnnnnnsnsn-3' (SEQ ID NO: 13967), or 5'-nsNfsnnnNfnnnnnnnnNfnNfnNfnsnsn-3' (SEQ ID NO: 13968), wherein "N" comprises one or more nucleosides, "Nf" is a 2' fluoro-modified nucleoside, "n" is a 2' O-methyl modified nucleoside, and "s" is a phosphorothioate linkage.

13. The composition of claim 1, wherein the sense strand comprises the nucleoside sequence of any of SEQ ID NOS: 13973 or a sense strand sequence thereof having 1 or 2 nucleoside substitutions, additions, or deletions; and wherein the antisense strand comprises the nucleoside sequence of SEQ ID NO: 13981 or an antisense strand sequence thereof having 1 or 2 nucleoside substitutions, additions, or deletions.

14. The composition of claim 1, wherein the sense strand comprises the nucleoside sequence of SEQ ID NO: 13977, and wherein the antisense strand comprises the nucleoside sequence of SEQ ID NO: 13985.

15. The composition of claim 14, wherein the sense strand comprises modification pattern 2S: 5'-nsnsnnNfnN fNfNfnnnnnnnnnnnsnsn-3' (SEQ ID NO: 13955), and wherein the antisense strand comprises modification pattern 3AS: 5'-nsNfsnnnNfnnnnnnnnNfnNfnnnsnsn-3' (SEQ ID NO: 13962), wherein "Nf" is a 2' fluoro-modified nucleoside, "n" is a 2' O-methyl modified nucleoside, and "s" is a phosphorothioate linkage.

16. The composition of claim 15, wherein the oligonucleotide comprises a GalNAc ligand attached at a 3' end of the sense strand.

17. The composition of claim 14, wherein the sense strand comprises modification pattern 6S: 5'-NfsnsNfn NfnNfnNfnNfnNfnNfnNfnNfsnsn-3' (SEQ ID NO: 13959), wherein "Nf" is a 2' fluoro-modified nucleoside, "n" is a 2' O-methyl modified nucleoside, and "s" is a phosphorothioate linkage.

18. The composition of claim 17, wherein the oligonucleotide comprises a GalNAc ligand attached at a 5' end of the sense strand.

19. The composition of claim 17, wherein the oligonucleotide comprises a GalNAc ligand attached at a 3' end of the sense strand.

20. The composition of claim 17, wherein the antisense strand comprises modification pattern 6AS: 5'-nsNfsnNfn NfnNfnNfnNfnNfnNfnNfnsnsn-3' (SEQ ID NO: 13965), or 8AS: 5'-nsNfsnnnnnnnnnnNfnnnnnsnsn-3' (SEQ ID NO: 13967), wherein "Nf" is a 2' fluoro-modified nucleoside, "n" is a 2' O-methyl modified nucleoside, and "s" is a phosphorothioate linkage.

* * * * *